United States Patent
Frejd et al.

(10) Patent No.: US 10,934,335 B2
(45) Date of Patent: Mar. 2, 2021

(54) IL-17A-BINDING POLYPEPTIDES

(71) Applicant: AFFIBODY AB, Solna (SE)

(72) Inventors: Fredrik Frejd, Stockholm (SE); Joachim Feldwisch, Tyresö (SE); Susanne Klint, Stockholm (SE); Lindvi Gudmundsdotter, Stockholm (SE)

(73) Assignee: AFFIBODY AB, Solna (SE)

( * ) Notice: Subject to any disclaimer, the term of this patent is extended or adjusted under 35 U.S.C. 154(b) by 311 days.

(21) Appl. No.: 15/538,890

(22) PCT Filed: Jan. 12, 2016

(86) PCT No.: PCT/EP2016/050456
§ 371 (c)(1),
(2) Date: Jun. 22, 2017

(87) PCT Pub. No.: WO2016/113246
PCT Pub. Date: Jul. 21, 2016

(65) Prior Publication Data
US 2017/0362290 A1   Dec. 21, 2017

(30) Foreign Application Priority Data
Jan. 12, 2015 (EP) .................................. 15150786

(51) Int. Cl.
| A61K 38/00 | (2006.01) |
| C07K 14/54 | (2006.01) |
| C07K 14/745 | (2006.01) |
| A61K 38/20 | (2006.01) |

(52) U.S. Cl.
CPC .............. *C07K 14/54* (2013.01); *A61K 38/20* (2013.01); *C07K 14/745* (2013.01); *A61K 38/00* (2013.01); *C07K 2318/20* (2013.01)

(58) Field of Classification Search
None
See application file for complete search history.

(56) References Cited

U.S. PATENT DOCUMENTS

2014/0205613 A1   7/2014 Voss et al.

FOREIGN PATENT DOCUMENTS

| EP | 2711016 A1 | 3/2013 |
| EP | 2597102 A1 | 5/2013 |
| WO | 2007065635 A1 | 6/2007 |
| WO | 2009077175 A1 | 6/2009 |
| WO | 2010102251 A2 | 9/2010 |
| WO | 2011023685 A1 | 3/2011 |
| WO | 2011110515 A1 | 9/2011 |
| WO | 2013126006 A1 | 8/2013 |
| WO | 2014044758 A1 | 3/2014 |
| WO | 2014064237 A1 | 5/2014 |
| WO | 2014140366 A1 | 9/2014 |

OTHER PUBLICATIONS

International Preliminary Report on Patentability of International Application No. PCT/EP2016/050456; dated Jul. 18, 2017; 10 pages.
Grimm, S. et al., "Selection and Characterisation of affibody molecules inhibiting the interaction between Ras and Raf in vitro", New Biotechnology, Elsevier BV, NL, vol. 27, No. 6, Dec. 31, 2010, pp. 766-773.
International Search Report for International Application No. PCT/EP2016/050456; Date of Filing: Jan. 12, 2016; dated Mar. 23, 2016; 7 pages.
Nygren, P., "Alternative binding proteins; Affibody binding proteins developed from a small three-helix bundle scaffold", FEBS Journal, Wiley Blackwell Publishing Ltd, GB vol. 275, No. 11, Jun. 1, 2008, pp. 2668-2676.
Silacci et al.; "Linker Length Matters, Fynomer-Fc Fusion with an Optimized Linker Displaying Picomolar IL-17A Inhibition Potency"; J. Bio. Chem., Volo. 289, No. 20; 2014; pp. 14392-14398.
Wahlberg et al., "An Affibody in Complex With a Target Protein: Structure and Coupled Folding", PNAS; vol. 100; No. 6; Mar. 18, 2003; pp. 3185-3190.
Written Opinion of the International Searching Authority for International Application No. PCT/EP2016/050456; Date of Filing: Jan. 12, 2016; dated Mar. 23, 2016; 7 pages.
Sergeeva, Anna et al., "Display technologies: Application for the discovery of drug and gene deliver agents", Advanced Drug Delivery Reviews 58, (2006) 1622-1654.
Tikunova, N.V. et al., "Phage Display on the Base of Filamentous Bacteriophages: Applicaton for Recombinant Antibodies Selection", ACTA Naturae No. 3 (2009); pp. 20-28.
Tokuriki, Nobuhiko, et al., "Stability effects of mutations and protein evolvability", Current Opinion in Structural Biology 2009, 19: 596-604.
Arnau, Jose et al., "Current strategies for the use of affinity tags and tag removal for the purificaton of recombinant proteins'", Protein Expression and Purification 48 (2006); pp. 1-13.
Shen, Ben-Quan, et al., "Conjugation site modulates the in vivo stability and therapeutic activity of antibody-drug conjugates", Nature Biotechnology, 2012, vol. 30, No. 2; pp. 184-192.

*Primary Examiner* — Dong Jiang
(74) *Attorney, Agent, or Firm* — Cantor Colburn LLP

(57) ABSTRACT

The present disclosure relates to a class of engineered polypeptides having a binding affinity for interleukin-17A (IL-17A), and provides an IL-17A binding polypeptide comprising the sequence $EX_2DX_4AX_6X_7EIX_{10}X_{11}$ LPNL $X_{16}X_{17}X_{18}QX_{20}X_{21}AFIX_{25}$ $X_{26}LX_{28}X_{29}$. Also disclosed is the use of such an interleukin-17A binding polypeptide as a diagnostic, prognostic and/or therapeutic agent.

19 Claims, 61 Drawing Sheets

Specification includes a Sequence Listing.

FIG. 1A

| Z number | SEQUENCE | SEQ ID NO |
|---|---|---|
| Z10532 | VDAKYAKEADDAAVEIASLPNLTWDQWYAFIQKLRDDPSQSSELLSEAKKLNDSQAPK | 1 |
| Z10508 | VDAKYAKEADDAAVEIAALPNLTWDQWFAFISKLRDDPSQSSELLSEAKKLNDSQAPK | 2 |
| Z10863 | VDAKYAKEADQAAVEIADLPNLTWAQWYAFIQKLRDDPSQSSELLSEAKKLNDSQAPK | 3 |
| Z15167 | VDAKYAKEADDAAVEIASLPNLTWAQWYAFIQKLRDDPSQSSELLSEAKKLNDSQAPK | 4 |
| Z12060 | VDAKYAKEADAAVEIAELPNLTWDQWAFINKLRDDPSQSSELLSEAKKLNDSQAPK | 5 |
| Z12081 | VDAKYAKEADDAALEIADLPNLTWDQWWAFISKLRDDPSQSSELLSEAKKLNDSQAPK | 6 |
| Z12634 | VDAKYAKEADRAAVEIADLPNLTWDQWYAFIEKLRDDPSQSSELLSEAKKLNDSQAPK | 7 |
| Z12078 | VDAKYAKEADQAAYEIAYLPNLTWDQWFAFITKLRDDPSQSSELLSEAKKLNDSQAPK | 8 |
| Z12163 | VDAKYAKEADDAAYEIAFLPNLTWDQWFAFINKLRDDPSQSSELLSEAKKLNDSQAPK | 9 |
| Z12264 | VDAKYAKEADDAAYEIAFLPNLTWDQWWAFIQKLRDDPSQSSELLSEAKKLNDSQAPK | 10 |
| Z10241 | VDAKYAKEADDAAVEIADLPNLTWDQWYAFISKLRDDPSQSSELLSEAKKLNDSQAPK | 11 |
| Z10462 | VDAKYAKEADEAAVEIADLPNLTWDQWYAFIQKLRDDPSQSSELLSEAKKLNDSQAPK | 12 |
| Z10534 | VDAKYAKEADDAAYEIADLPNLTWDQWFAFIGKLRDDPSQSSELLSEAKKLNDSQAPK | 13 |
| Z10566 | VDAKYAKEADDAAIEIASLPNLTWDQWYAFIGKLRDDPSQSSELLSEAKKLNDSQAPK | 14 |
| Z10675 | VDAKYAKEADDAAYEIAFLPNLTWDQWFAFIQKLRDDPSQSSELLSEAKKLNDSQAPK | 15 |
| Z10718 | VDAKYAKEADDAAVEIADLPNLTWDQWHAFIQKLRDDPSQSSELLSEAKKLNDSQAPK | 16 |
| Z12059 | VDAKYAKEADDAAYEIAFLPNLTWDQWFAFISKLRDDPSQSSELLSEAKKLNDSQAPK | 17 |
| Z12073 | VDAKYAKEADDAAYEIADLPNLTWDQWYAFITKLRDDPSQSSELLSEAKKLNDSQAPK | 18 |
| Z12077 | VDAKYAKEADDAAVEIADLPNLTWDQWYAFIQKLRDDPSQSSELLSEAKKLNDSQAPK | 19 |
| Z12115 | VDAKYAKEADDAAYEIAFLPNLTWDQWYAFIQKLRDDPSQSSELLSEAKKLNDSQAPK | 20 |
| Z12180 | VDAKYAKEADDAAVEIADLPNLTWDQWWAFIGKLRDDPSQSSELLSEAKKLNDSQAPK | 21 |
| Z12211 | VDAKYAKEADEAAVEIADLPNLTWDQWWAFINKLRDDPSQSSELLSEAKKLNDSQAPK | 22 |
| Z12256 | VDAKYAKEADDAAYEIAFLPNLTWDQWYAFINKLRDDPSQSSELLSEAKKLNDSQAPK | 23 |
| Z12275 | VDAKYAKEADDAAVEIADLPNLTWDQWFAFIRKLRDDPSQSSELLSEAKKLNDSQAPK | 24 |
| Z12283 | VDAKYAKEADDAAYEIAFLPNLTWEQWYAFIDKLRDDPSQSSELLSEAKKLNDSQAPK | 25 |
| Z12344 | VDAKYAKEADDAAVEIAYLPNLTWDQWWAFIRKLRDDPSQSSELLSEAKKLNDSQAPK | 26 |
| Z12481 | VDAKYAKEADDAAVEIADLPNLTWDQWWAFILKLRDDPSQSSELLSEAKKLNDSQAPK | 27 |
| Z10433 | VDAKYAKEADDAAFEIAALPNLTWDQWYAFIIKLRDDPSQSSELLSEAKKLNDSQAPK | 28 |

FIG. 1B

| | | |
|---|---|---|
| Z10681 | VDAKYAKEADEAAVEIAELPNLTWDQWYAFIRKLRDDPSQSSELLSEAKKLNDSQAPK | 29 |
| Z10722 | VDAKYAKEADDAALEIAELPNLTWVQWYAFIQKLRDDPSQSSELLSEAKKLNDSQAPK | 30 |
| Z10859 | VDAKYAKEADFAAVEIAELPNLTWDQWYAFIQKLRDDPSQSSELLSEAKKLNDSQAPK | 31 |
| Z12192 | VDAKYAKEADDAAVEIADLPNLTWAQWEAFISKLRDDPSQSSELLSEAKKLNDSQAPK | 32 |
| Z12289 | VDAKYAKEADDAAYEIAGLPNLTWDQWYAFIEKLRDDPSQSSELLSEAKKLNDSQAPK | 33 |
| Z12498 | VDAKYAKEADDAAYEIASLPNLTWDQWAFIGKLRDDPSQSSELLSEAKKLNDSQAPK | 34 |
| Z12522 | VDAKYAKEADRAAVEIADLPNLTWDQWWAFIEKLRDDPSQSSELLSEAKKLNDSQAPK | 35 |
| Z10210 | VDAKYAKEMDYAQWEIWLLPNLTWDQGHAFISKLIDDPSQSSELLSEAKKLNDSQAPK | 36 |
| Z10255 | VDAKYAKEADDAAVEIADLPNLTWDQWFAFIHKLRDDPSQSSELLSEAKKLNDSQAPK | 37 |
| Z10257 | VDAKYAKEADDAAFEIAMLPNLTWDQWYAFIQKLRDDPSQSSELLSEAKKLNDSQAPK | 38 |
| Z10459 | VDAKYAKEADNAAVEIADLPNLTWVQWYAFIQKLRDDPSQSSELLSEAKKLNDSQAPK | 39 |
| Z10465 | VDAKYAKEADDAAVEIAELPNLTWDQWFAFIQKLRDDPSQSSELLSEAKKLNDSQAPK | 40 |
| Z10470 | VDAKYAKEADDAAVEIASLPNLTWDQWYAFISKLRDDPSQSSELLSEAKKLNDSQAPK | 41 |
| Z10483 | VDAKYAKEADQAAVEIADLPNLTWDQWYAFIQKLRDDPSQSSELLSEAKKLNDSQAPK | 42 |
| Z10529 | VDAKYAKEADDAAVEIAMLPNLTWDQWYAFIQKLRDDPSQSSELLSEAKKLNDSQAPK | 43 |
| Z10550 | VDAKYAKEADDAAVEIADLPNLTWDQWFAFIHKLRDDPSQSSELLSEAKKLNDSQAPK | 44 |
| Z10565 | VDAKYAKEADEAAVEIADLPNLTWDQWYAFIAKLRDDPSQSSELLSEAKKLNDSQAPK | 45 |
| Z10676 | VDAKYAKEADDAAVEIADLPNLTWDQWYAFIQKLRDDPSQSSELLSEAKKLNDSQAPK | 46 |
| Z10690 | VDAKYAKEADDAAVEIAMLPNLTWDQWYAFIGKLRDDPSQSSELLSEAKKLNDSQAPK | 47 |
| Z10703 | VDAKYAKEADRAAMEIAELPNLTWDQWYAFISKLRDDPSQSSELLSEAKKLNDSQAPK | 48 |
| Z10708 | VDAKYAKEADDAAVEIAELPNLTWDQWYAFIQKLRDDPSQSSELLSEAKKLNDSQAPK | 49 |
| Z10710 | VDAKYAKEADNAAVEIAMLPNLTWDQWYAFIQKLRDDPSQSSELLSEAKKLNDSQAPK | 50 |
| Z10728 | VDAKYAKEADDAAYEIAMLPNLTWDQWYAFIGKLRDDPSQSSELLSEAKKLNDSQAPK | 51 |
| Z10745 | VDAKYAKEADNAAVEIASLPNLTWDQWYAFIGKLRDDPSQSSELLSEAKKLNDSQAPK | 52 |
| Z10756 | VDAKYAKEADDAAVEIALLPNLTWDQWYAFISKLRDDPSQSSELLSEAKKLNDSQAPK | 53 |
| Z10759 | VDAKYAKEADDAAVEIASLPNLTWDQWFAFIGKLRDDPSQSSELLSEAKKLNDSQAPK | 54 |
| Z10775 | VDAKYAKEADDAAVEIADLPNLTWDQWFAFIGKLRDDPSQSSELLSEAKKLNDSQAPK | 55 |
| Z10778 | VDAKYAKEADDAAVEIAQLPNLTWAQWFAFIQKLRDDPSQSSELLSEAKKLNDSQAPK | 56 |
| Z10779 | VDAKYAKEADDAAVEIAALPNLTWDQWFAFIQKLRDDPSQSSELLSEAKKLNDSQAPK | 57 |

FIG. 1C

| ID | Sequence | # |
|---|---|---|
| Z10800 | VDAKYAKEADNAAVEIADLPNLTWDQWYAFIAKLRDDPSQSSELLSEAKKLNDSQAPK | 58 |
| Z10807 | VDAKYAKEADEAAVEIAELPNLTWDQWYAFIGKLRDDPSQSSELLSEAKKLNDSQAPK | 59 |
| Z10844 | VDAKYAKEADNAAMEIADLPNLTWDQWFAFIQKLRDDPSQSSELLSEAKKLNDSQAPK | 60 |
| Z10857 | VDAKYAKEADDAAVEIAALPNLTWDQWYAFIQKLRDDPSQSSELLSEAKKLNDSQAPK | 61 |
| Z10858 | VDAKYAKEADDAAVEIAELPNLTWAQWFAFIGKLRDDPSQSSELLSEAKKLNDSQAPK | 62 |
| Z10914 | VDAKYAKEADDAAVEIADLPNLTWDQWYAFIQKLRDDPSQSSELLSEAKKLNDSQAPK | 63 |
| Z12212 | VDAKYAKEADDAAVEIALLPNLTWDQWYAFINKLRDDPSQSSELLSEAKKLNDSQAPK | 64 |
| Z12285 | VDAKYAKEADNAALEIANLPNLTWDQWAFITKLRDDPSQSSELLSEAKKLNDSQAPK | 65 |
| Z12439 | VDAKYAKEADMAAVEIAELPNLTWEQWFAFIGKLRDDPSQSSELLSEAKKLNDSQAPK | 66 |
| Z10249 | VDAKYAKEADEAAVEIAMLPNLTWDQWHAFIHKLRDDPSQSSELLSEAKKLNDSQAPK | 67 |
| Z10424 | VDAKYAKEADNAAWEIASLPNLTWDQWFAFIGKLRDDPSQSSELLSEAKKLNDSQAPK | 68 |
| Z10449 | VDAKYAKEADRAAVEIAELPNLTWDQWFAFIGKLRDDPSQSSELLSEAKKLNDSQAPK | 69 |
| Z10454 | VDAKYAKEADDAAMEIADLPNLTWAQWFAFIQKLRDDPSQSSELLSEAKKLNDSQAPK | 70 |
| Z10463 | VDAKYAKEADNAAFEIAALPNLTWDQWSAFIQKLRDDPSQSSELLSEAKKLNDSQAPK | 71 |
| Z10485 | VDAKYAKEADEAAVEIAELPNLTWDQWFAFIGKLRDDPSQSSELLSEAKKLNDSQAPK | 72 |
| Z10505 | VDAKYAKEADDAAVEIALLPNLTWAQWFAFIQKLRDDPSQSSELLSEAKKLNDSQAPK | 73 |
| Z10516 | VDAKYAKEADDAAVEIADLPNLTWDQWYAFIVKLRDDPSQSSELLSEAKKLNDSQAPK | 74 |
| Z10531 | VDAKYAKEADNAALEIALLPNLTWDQWNAFIRKLRDDPSQSSELLSEAKKLNDSQAPK | 75 |
| Z10539 | VDAKYAKEADNAAMEIADLPNLTWAQWHAFIQKLRDDPSQSSELLSEAKKLNDSQAPK | 76 |
| Z10540 | VDAKYAKEADNAAVEIAALPNLTWDQWFAFIHKLRDDPSQSSELLSEAKKLNDSQAPK | 77 |
| Z10556 | VDAKYAKEADDAALEIADLPNLTWDQWSAFISKLRDDPSQSSELLSEAKKLNDSQAPK | 78 |
| Z10663 | VDAKYAKEADQAAVEIALLPNLTWAQWFAFIVKLRDDPSQSSELLSEAKKLNDSQAPK | 79 |
| Z10664 | VDAKYAKEADDAAVEIATLPNLTWDQWSAFIRKLRDDPSQSSELLSEAKKLNDSQAPK | 80 |
| Z10668 | VDAKYAKEADDAAVEIADLPNLTWDQWFAFIRKLRDDPSQSSELLSEAKKLNDSQAPK | 81 |
| Z10674 | VDAKYAKEADEAAFEIAAFEIADLPNLTWDQWFAFIRKLRDDPSQSSELLSEAKKLNDSQAPK | 82 |
| Z10693 | VDAKYAKEADDAAVEIADLPNLTYDQWFAFIGKLRDDPSQSSELLSEAKKLNDSQAPK | 83 |
| Z10733 | VDAKYAKEADDAAFEIADLPNLTWDQWHAFITKLRDDPSQSSELLSEAKKLNDSQAPK | 84 |
| Z10734 | VDAKYAKEADDAAFEIADLPNLTWAQWFAFIGKLRDDPSQSSELLSEAKKLNDSQAPK | 85 |
| Z10746 | VDAKYAKEADEAAFEIADLPNLTWVQWFAFIQKLRDDPSQSSELLSEAKKLNDSQAPK | 86 |

FIG. 1D

| | | |
|---|---|---|
| ZI0748 | VDAKYAKEADQAAVEIADLPNLTWDQWFAFIGKLRDDPSQSSELLSEAKKLNDSQAPK | 87 |
| ZI0757 | VDAKYAKEADDAAMEIAELPNLTWAQWSAFIAKLRDDPSQSSELLSEAKKLNDSQAPK | 88 |
| ZI0774 | VDAKYAKEADDAAIEIAELPNLTWDQWYAFIGKLRDDPSQSSELLSEAKKLNDSQAPK | 89 |
| ZI0780 | VDAKYAKEADDAAFEIALLPNLTWDQWSAFIQKLRDDPSQSSELLSEAKKLNDSQAPK | 90 |
| ZI0790 | VDAKYAKEADEAAMEIAELPNLTWDQWFAFISKLRDDPSQSSELLSEAKKLNDSQAPK | 91 |
| ZI0791 | VDAKYAKEADDAAFEIAALPNLTWDQWFAFIGKLRDDPSQSSELLSEAKKLNDSQAPK | 92 |
| ZI0793 | VDAKYAKEADEAAVEIASLPNLTWDQWHAFIIKLRDDPSQSSELLSEAKKLNDSQAPK | 93 |
| ZI0805 | VDAKYAKEADRAAVEIASLPNLTWAQWHAFIQKLRDDPSQSSELLSEAKKLNDSQAPK | 94 |
| ZI0868 | VDAKYAKEADNAAVEIAALPNLTWDQWHAFIQKLRDDPSQSSELLSEAKKLNDSQAPK | 95 |
| ZI0880 | VDAKYAKEADAAMEIADLPNLTWVQWSAFISKLRDDPSQSSELLSEAKKLNDSQAPK | 96 |
| ZI0881 | VDAKYAKEADEAAVEIATLPNLTWDQWFAFIQKLRDDPSQSSELLSEAKKLNDSQAPK | 97 |
| ZI0887 | VDAKYAKEADEAAVEIALLPNLTWDQWHAFIGKLRDDPSQSSELLSEAKKLNDSQAPK | 98 |
| ZI0892 | VDAKYAKEADEAAVEIASLPNLTWDQWYAFIRKLRDDPSQSSELLSEAKKLNDSQAPK | 99 |
| ZI0893 | VDAKYAKEADDAALEIAELPNLTWDQWYAFIVKLRDDPSQSSELLSEAKKLNDSQAPK | 100 |
| ZI0896 | VDAKYAKEADDAAFEIAALPNLTWDQWSAFIQKLRDDPSQSSELLSEAKKLNDSQAPK | 101 |
| ZI0897 | VDAKYAKEADDAAVEIADLPNLTWDQWYAFIQKLRDDPSQSSELLSEAKKLNDSQAPK | 102 |
| ZI0903 | VDAKYAKEADDAAVEIAELPNLTWRQWYAFIGKLRDDPSQSSELLSEAKKLNDSQAPK | 103 |
| ZI0912 | VDAKYAKEADDAAVEIADLPNLTWDQWFAFIRKLRDDPSQSSELLSEAKKLNDSQAPK | 104 |
| ZI0916 | VDAKYAKEADDAAVEIADLPNLTWDQWFAFIVKLRDDPSQSSELLSEAKKLNDSQAPK | 105 |
| ZI0931 | VDAKYAKEADDAAMEIADLPNLTWDQWFAFISKLRDDPSQSSELLSEAKKLNDSQAPK | 106 |
| ZI0932 | VDAKYAKEADDAAVEIADLPNLTWRQWFAFIQKLRDDPSQSSELLSEAKKLNDSQAPK | 107 |
| ZI0947 | VDAKYAKEADDAAFEIALPNLTWHQWNAFIQKLRDDPSQSSELLSEAKKLNDSQAPK | 108 |
| ZI0958 | VDAKYAKEADDAAVEIAALPNLTWRQWYAFIQKLRDDPSQSSELLSEAKKLNDSQAPK | 109 |
| ZI0960 | VDAKYAKEADDAAMEIAELPNLTWAQWYAFIQKLRDDPSQSSELLSEAKKLNDSQAPK | 110 |
| ZI0964 | VDAKYAKEADQAAVEIADLPNLTTAQWYAFIQKLRDDPSQSSELLSEAKKLNDSQAPK | 111 |
| ZI0966 | VDAKYAKEADQAAVEIADLPNLTWHQWHAFIIKLRDDPSQSSELLSEAKKLNDSQAPK | 112 |
| ZI0970 | VDAKYAKEADYAAFEIAAFPNLTWRQWHAFIRKLRDDPSQSSELLSEAKKLNDSQAPK | 113 |
| ZI0972 | VDAKYAKEADDAAFEIAELPNLTWDQWHAFISKLRDDPSQSSELLSEAKKLNDSQAPK | 114 |
| ZI0201 | VDAKYAKEYDEAWFEIWALPNLTWDQVAVAFIRKLNDDPSQSSELLSEAKKLNDSQAPK | 115 |

FIG. 1E

| | | |
|---|---|---|
| Z10202 | VDAKYAKEADEAWFEIWTLPNLTHAQQVAFIRKLIDDPSQSSELLSEAKKLNDSQAPK | 116 |
| Z10203 | VDAKYAKEMDDAWWEIWSLPNLTYDQQYAFIVKLLDDPSQSSELLSEAKKLNDSQAPK | 117 |
| Z10204 | VDAKYAKEHDNAWFEIWSLPNLTWDQARAFIVKLNDDPSQSSELLSEAKKLNDSQAPK | 118 |
| Z10205 | VDAKYAKEADYAWFEIWMLPNLTYDQQKAFIVKLNDDPSQSSELLSEAKKLNDSQAPK | 119 |
| Z10206 | VDAKYAKEMDDAQWEIWLLPNLTWDQHAFIQKLIDDPSQSSELLSEAKKLNDSQAPK | 120 |
| Z10207 | VDAKYAKEMADAQWEIWMLPNLTWAQGNAFISKLIDDPSQSSELLSEAKKLNDSQAPK | 121 |
| Z10209 | VDAKYAKEMDDAQWEIWMLPNLTWHQSHAFIRKLLDDPSQSSELLSEAKKLNDSQAPK | 122 |
| Z10211 | VDAKYAKEMAYAQWEIWLLPNLTYDQGHAFIVKLLDDPSQSSELLSEAKKLNDSQAPK | 123 |
| Z10212 | VDAKYAKEMDEAWFEIWMLPNLTYVQQVAFIVKLLDDPSQSSELLSEAKKLNDSQAPK | 124 |
| Z10213 | VDAKYAKEHDYAWFEIWALPNLTWDQQVAFIHKLNDDPSQSSELLSEAKKLNDSQAPK | 125 |
| Z10214 | VDAKYAKEMDEAQWEIWLLPNLTWDQSNAFIRKLIDDPSQSSELLSEAKKLNDSQAPK | 126 |
| Z10216 | VDAKYAKEWDEAQWEIWLLPNLTWHQQNAFIRKLIDDPSQSSELLSEAKKLNDSQAPK | 127 |
| Z10217 | VDAKYAKEYDYAWFEIWELPNLTWDQQYAFIQKLNDDPSQSSELLSEAKKLNDSQAPK | 128 |
| Z10218 | VDAKYAKEADEAWWEIWSLPNLTYAQAYAFIQKLIDDPSQSSELLSEAKKLNDSQAPK | 129 |
| Z10219 | VDAKYAKEHDYAWFEIWMLPNLTWDQQYAFIHKLNDDPSQSSELLSEAKKLNDSQAPK | 130 |
| Z10220 | VDAKYAKEADFAWFEIWMLPNLTWDQQYAFISKLNDDPSQSSELLSEAKKLNDSQAPK | 131 |
| Z10221 | VDAKYAKEMDEAQWEIWLLPNLTWHQQNAFIRKLIDDPSQSSELLSEAKKLNDSQAPK | 132 |
| Z10222 | VDAKYAKEMDDAQWEIWLLPNLTWAQSNAFIRKLIDDPSQSSELLSEAKKLNDSQAPK | 133 |
| Z10223 | VDAKYAKEMDEAQWEIWTLPNLTWAQSHAFISKLIDDPSQSSELLSEAKKLNDSQAPK | 134 |
| Z10224 | VDAKYAKEADEAWFEIWALPNLTWDQAVAFIHKLNDDPSQSSELLSEAKKLNDSQAPK | 135 |
| Z10225 | VDAKYAKEYDYAWFEIWLLPNLTWVQQTAFIRKLIDDPSQSSELLSEAKKLNDSQAPK | 136 |
| Z10226 | VDAKYAKEADEAWFEIWLLPNLTHDQGVAFIRKLLDDPSQSSELLSEAKKLNDSQAPK | 137 |
| Z10227 | VDAKYAKEMDEAQWEIWLLPNLTWAQSRAFIQKLIDDPSQSSELLSEAKKLNDSQAPK | 138 |
| Z10228 | VDAKYAKEMDEAWWEIWLLPNLTHDQCQFAFIVKLIDDPSQSSELLSEAKKLNDSQAPK | 139 |
| Z10229 | VDAKYAKEYDYAWFEIWTLPNLTWDQQKAFIHKLNDDPSQSSELLSEAKKLNDSQAPK | 140 |
| Z10230 | VDAKYAKEMDYAQWEIWLLPNLTWDQQHAFIQKLISDPSQSSELLSEAKKLNDSQAPK | 141 |
| Z10231 | VDAKYAKEHDDAWWEIWLLPNLTHDQAYAFIVKLNDDPSQSSELLSEAKKLNDSQAPK | 142 |
| Z10232 | VDAKYAKEMGYAQLEIWLLPNLTWHQSNAFIRKLIDDPSQSSELLSEAKKLNDSQAPK | 143 |
| Z10233 | VDAKYAKEMDEAQWEIWLLPNLTHDQQTAFIRKLIDDPSQSSELLSEAKKLNDSQAPK | 144 |

FIG. 1F

| ID | Sequence | # |
|---|---|---|
| Z10234 | VDAKYAKEMDYAQWEIWLLPNLTWDQGNAFIRKLIDDPSQSSELLSEAKKLNDSQAPK | 145 |
| Z10235 | VDAKYAKEMDFAQWEIWTLPNLTWDQSNAFIRKLIDDPSQSSELLSEAKKLNDSQAPK | 146 |
| Z10236 | VDAKYAKEADYAWWEIWALPNLTHAQQVAFIQKLLDDPSQSSELLSEAKKLNDSQAPK | 147 |
| Z10237 | VDAKYAKEMDYAQWEIWLLPNLTYDQGHAFIQKLLDDPSQSSELLSEAKKLNDSQAPK | 148 |
| Z10238 | VDAKYAKEMDDAQWEIWMLPNLTWAQSHAFIVKLLDDPSQSSELLSEAKKLNDSQAPK | 149 |
| Z10239 | VDAKYAKEYDQAWFEIWMLPNLTHRQRAFIHKLNDDPSQSSELLSEAKKLNDSQAPK | 150 |
| Z10240 | VDAKYAKEMDNAQWEIWMLPNLTWDQGRAFIVKLIDDPSQSSELLSEAKKLNDSQAPK | 151 |
| Z10242 | VDAKYAKEHDEAWFEIWMLPNLTWHQARAFIVKLNDDPSQSSELLSEAKKLNDSQAPK | 152 |
| Z10243 | VDAKYAKEMDDAQIEIWMLPNLTWAQGHAFIRKLIDDPSQSSELLSEAKKLNDSQAPK | 153 |
| Z10244 | VDAKYAKEADYAQWEIWLLPNLTHAQGTAFIQKLLDDPSQSSELLSEAKKLNDSQAPK | 154 |
| Z10245 | VDAKYAKEMDFAQWEIWMLPNLTWDQAHAFIQKLLDDPSQSSELLSEAKKLNDSQAPK | 155 |
| Z10246 | VDAKYAKEYDEAWFEIWSLPNLTYDQQYAFIVKLLDDPSQSSELLSEAKKLNDSQAPK | 156 |
| Z10247 | VDAKYAKEHDYAWFEIWALPNLTHDQQVAFIRKLNDDPSQSSELLSEAKKLNDSQAPK | 157 |
| Z10248 | VDAKYAKEMDYAWFEIWMLPNLTHDQARAFIVKLIDDPSQSSELLSEAKKLNDSQAPK | 158 |
| Z10250 | VDAKYAKEMDEAWWEIWTLPNLTYAQARAFIVKLIDDPSQSSELLSEAKKLNDSQAPK | 159 |
| Z10251 | VDAKYAKEMDEAQWEIWLLPNLTWVQQNAFIVKLIDDPSQSSELLSEAKKLNDSQAPK | 160 |
| Z10252 | VDAKYAKEMDEAQWEIWMLPNLTWAQGNAFIHKLLDDPSQSSELLSEAKKLNDSQAPK | 161 |
| Z10254 | VDAKYAKEMDEAQWEIWMLPNLTWHQQNAFIQKLIDDPSQSSELLSEAKKLNDSQAPK | 162 |
| Z10256 | VDAKYAKEADNAQWEIWLLPNLTWAQGHAFIQKLIDDPSQSSELLSEAKKLNDSQAPK | 163 |
| Z10258 | VDAKYAKEMDEAQWEIWLLPNLTWAQQNAFISKLIDDPSQSSELLSEAKKLNDSQAPK | 164 |
| Z10259 | VDAKYAKEMDEAWFEIWLLPNLTWDQQYAFIQKLIDDPSQSSELLSEAKKLNDSQAPK | 165 |
| Z10260 | VDAKYAKEMDDAWFEIWLLPNLTWDQGNAFIRKLIDDPSQSSELLSEAKKLNDSQAPK | 166 |
| Z10261 | VDAKYAKEHAEAWFEIWALPNLTHAQQYAFIHKLLDDPSQSSELLSEAKKLNDSQAPK | 167 |
| Z10262 | VDAKYAKEMDEAQWEIWMLPNLTHQQQHAFIVKLIDDPSQSSELLSEAKKLNDSQAPK | 168 |
| Z10263 | VDAKYAKEMDDAQWEIWMLPNLTWDQGNAFIVKLIDDPSQSSELLSEAKKLNDSQAPK | 169 |
| Z10265 | VDAKYAKEMDEAQWEIWMLPNLTHDQQYAFIVKLLNDDPSQSSELLSEAKKLNDSQAPK | 170 |
| Z10266 | VDAKYAKEHDQAWFEIWALPNLTHAQAVAFIVKLLDDPSQSSELLSEAKKLNDSQAPK | 171 |
| Z10267 | VDAKYAKEADEAWWEIWLLPNLTHDQQYAFISKLLDDPSQSSELLSEAKKLNDSQAPK | 172 |
| Z10268 | VDAKYAKEMDYAWFEIWALPNLTYDQQYAFISKLLDDPSQSSELLSEAKKLNDSQAPK | 173 |

FIG. 1G

| ID | Sequence | # |
|---|---|---|
| Z10269 | VDAKYAKEADFAWWEIWSLPNLTHHQAKAFIVKLIDDPSQSSELLSEAKKLNDSQAPK | 174 |
| Z10270 | VDAKYAKEMDYAQWEIWMLPNLTWDQSHAFIQKLIDDPSQSSELLSEAKKLNDSQAPK | 175 |
| Z10271 | VDAKYAKEMDDAQWEIWMLPNLTHDQGKAFIQKLIDDPSQSSELLSEAKKLNDSQAPK | 176 |
| Z10272 | VDAKYAKEADEAWFEIWMLPNLTYAQQVAFIRKLNDDPSQSSELLSEAKKLNDSQAPK | 177 |
| Z10273 | VDAKYAKEMDEAQWEIWLLPNLTYAQQSAFIQKLIDDPSQSSELLSEAKKLNDSQAPK | 178 |
| Z10274 | VDAKYAKEMDFAQWEIWLLPNLTWDQQHAFIQKLIDDPSQSSELLSEAKKLNDSQAPK | 179 |
| Z10275 | VDAKYAKEMDDAWWEIWALPNLTYDQQYAFIAKLIDDPSQSSELLSEAKKLNDSQAPK | 180 |
| Z10276 | VDAKYAKEMDEAQWEIWMLPNLTWDQSHAFIQKLIDDPSQSSELLSEAKKLNDSQAPK | 181 |
| Z10277 | VDAKYAKEHDYAWFEIWLLPNLTYDQQHAFIVKLNDDPSQSSELLSEAKKLNDSQAPK | 182 |
| Z10278 | VDAKYAKEMDYAWWEIWLLPNLTHDQAKAFIQKLLDDPSQSSELLSEAKKLNDSQAPK | 183 |
| Z10279 | VDAKYAKEADEAQWEIWTLPNLTWDQGHAFIRKLIDDPSQSSELLSEAKKLNDSQAPK | 184 |
| Z10280 | VDAKYAKEMDYAQWEIWLLPNLTHAQNAFIQKLIDDPSQSSELLSEAKKLNDSQAPK | 185 |
| Z10282 | VDAKYAKEADYAWWEIWLLPNLTHAQQTAFIHKLLDDPSQSSELLSEAKKLNDSQAPK | 186 |
| Z10292 | VDAKYAKEMDYAQWEIWMLPNLTHAQSRAFIQKLIDDPSQSSELLSEAKKLNDSQAPK | 187 |
| Z10336 | VDAKYAKEYDYAWFEIWAWPNLTHHQQVAFIRKLNDDPSQSSELLSEAKKLNDSQAPK | 188 |
| Z10341 | VDAKYAKEMDDAWWEIWLLPNLTHDQQRAFIVKLLDDPSQSSELLSEAKKLNDSQAPK | 189 |
| Z10343 | VDAKYAKEMDNAWWEIWTLPNLTHDQAVAFIRKLIDDPSQSSELLSEAKKLNDSQAPK | 190 |
| Z10344 | VDAKYAKEMDFAQWEIWLLPNLTHHQQNAFIRKLIDDPSQSSELLSEAKKLNDSQAPK | 191 |
| Z10361 | VDAKYAKEADQAWWEIWALPNLTHDQAVAFIRKLIDDPSQSSELLSEAKKLNDSQAPK | 192 |
| Z10366 | VDAKYAKEYDYAWFEIWALPNLTRAQATAFISKLNDDPSQSSELLSEAKKLNDSQAPK | 193 |
| Z10367 | VDAKYAKEADYAWFEIWALPNLTYAQQVAFIQKLIDDPSQSSELLSEAKKLNDSQAPK | 194 |
| Z10369 | VDAKYAKEAGYAWFEIWSLPNLTHRQQVAFIVKLNDDPSQSSELLSEAKKLNDSQAPK | 195 |
| Z10375 | VDAKYAKEHGDAWFEIWLLPNLTWDQQQRAFIVKLLDDPSQSSELLSEAKKLNDSQAPK | 196 |
| Z10376 | VDAKYAKEADEAWFEIWALPNLTHDQGKAFIRKLIDDPSQSSELLSEAKKLNDSQAPK | 197 |
| Z10377 | VDAKYAKEADYAWWEIWLLPNLTHDQARAFISKLNDDPSQSSELLSEAKKLNDSQAPK | 198 |
| Z10379 | VDAKYAKEADEAWWEIWLLPNLTHAQQVAFIRKLIDDPSQSSELLSEAKKLNDSQAPK | 199 |
| Z10380 | VDAKYAKEADYAWFEIWSLPNLTWDQSRAFIGKLNDDPSQSSELLSEAKKLNDSQAPK | 200 |
| Z10385 | VDAKYAKEMDFAWFEIWALPNLTHVQQVAFIRKLIDDPSQSSELLSEAKKLNDSQAPK | 201 |
| Z10387 | VDAKYAKEADEAWFEIWALPNLTYDQSKAFIRKLIDDPSQSSELLSEAKKLNDSQAPK | 202 |

FIG. 1H

| | | |
|---|---|---|
| Z10389 | VDAKYAKEADYAWFEIWALPNLTHAQQYAFIQKLNDDPSQSSELLSEAKKLNDSQAPK | 203 |
| Z10390 | VDAKYAKEYLYAWMEIWTLPNLTWDQARAFIVKLLDDPSQSSELLSEAKKLNDSQAPK | 204 |
| Z10391 | VDAKYAKEYDFAWFEIWALPNLTHDQGKAFISKLNDDPSQSSELLSEAKKLNDSQAPK | 205 |
| Z10401 | VDAKYAKEADYAWWEIWSLPNLTHAQAYAFIRKLIDDPSQSSELLSEAKKLNDSQAPK | 206 |
| Z10402 | VDAKYAKEADYAWWEIWALPNLTHAQAVAFIQKLLDDPSQSSELLSEAKKLNDSQAPK | 207 |
| Z10404 | VDAKYAKEMDYAWWEIWLLPNLTHDQQVAFIRKLIDDPSQSSELLSEAKKLNDSQAPK | 208 |
| Z10409 | VDAKYAKEWDYAWWEIWALPNLTHDQARAFIIKLNDDPSQSSELLSEAKKLNDSQAPK | 209 |
| Z10410 | VDAKYAKEMDFAWWEIWSLPNLTHAQARAFIVKLIDDPSQSSELLSEAKKLNDSQAPK | 210 |
| Z10415 | VDAKYAKEADYAWWEIWALPNLTHAQQVAFISKLLDDPSQSSELLSEAKKLNDSQAPK | 211 |
| Z10417 | VDAKYAKEADYAWWEIWSLPNLTHAQAKAFIQKLIDDPSQSSELLSEAKKLNDSQAPK | 212 |
| Z10420 | VDAKYAKEHDYAWFEIWMLPNLTHQQVAFIHKLNDDPSQSSELLSEAKKLNDSQAPK | 213 |
| Z10422 | VDAKYAKEMDYAWFEIWDLPNLTYDQAVAFIHKLNDDPSQSSELLSEAKKLNDSQAPK | 214 |
| Z10423 | VDAKYAKEYDYAWFEIWALPNLTHAQQVAFIQKLIDDPSQSSELLSEAKKLNDSQAPK | 215 |
| Z10426 | VDAKYAKEYDYAWFEIWLLPNLTYDQQRAFIVKLNDDPSQSSELLSEAKKLNDSQAPK | 216 |
| Z10428 | VDAKYAKEADYAWFEIWSLPNLTHDQQVAFIRKLIDDPSQSSELLSEAKKLNDSQAPK | 217 |
| Z10430 | VDAKYAKEHDYAWFEIDEAWWEIWLLPNLTHDQAYAFIHKLNDDPSQSSELLSEAKKLNDSQAPK | 218 |
| Z10431 | VDAKYAKEMDYAQFEIWLLPNLTWAQSNAFIRKLIDDPSQSSELLSEAKKLNDSQAPK | 219 |
| Z10434 | VDAKYAKEADYAWFEIWDLPNLTYDQQYAFIRKLLDDPSQSSELLSEAKKLNDSQAPK | 220 |
| Z10435 | VDAKYAKEMDYAWFEIWALPNLTHDQAVAFIQKLLDDPSQSSELLSEAKKLNDSQAPK | 221 |
| Z10438 | VDAKYAKEADYAQWEIWLLPNLTHAQQTAFIRKLLDDPSQSSELLSEAKKLNDSQAPK | 222 |
| Z10440 | VDAKYAKEYDNAWFEIWLLPNLTHDQQHAFIQKLIDDPSQSSELLSEAKKLNDSQAPK | 223 |
| Z10441 | VDAKYAKEADYAQWEIWMLPNLTYDQQHAFIRKLLDDPSQSSELLSEAKKLNDSQAPK | 224 |
| Z10442 | VDAKYAKEMDEAQWEIWLLPNLTWAQGNAFIWQGNAFIQKLIDDPSQSSELLSEAKKLNDSQAPK | 225 |
| Z10443 | VDAKYAKEMDFAQLEIWTLPNLTWAQGHAFIQKLIDDPSQSSELLSEAKKLNDSQAPK | 226 |
| Z10444 | VDAKYAKEYDYAWFEIWLLPNLTHDQQRAFIVKLNDDPSQSSELLSEAKKLNDSQAPK | 227 |
| Z10445 | VDAKYAKEMDEAQWEIWMLPNLTYDQQHAFIRKLLDDPSQSSELLSEAKKLNDSQAPK | 228 |
| Z10446 | VDAKYAKEHDYAWFEIWLLPNLTWDQQTAFIHKLNDDPSQSSELLSEAKKLNDSQAPK | 229 |
| Z10447 | VDAKYAKEMDQAQWEIWLLPNLTWHQSHAFISKLIDDPSQSSELLSEAKKLNDSQAPK | 230 |
| Z10450 | VDAKYAKEADYAWFEIWALPNLTHDQARAFIRKLIDDPSQSSELLSEAKKLNDSQAPK | 231 |

FIG. 1I

| | | |
|---|---|---|
| Z10451 | VDAKYAKEMDDAQWEIWLLPNLTWDQQHAFIVKLIDDPSQSSELLSEAKKLNDSQAPK | 232 |
| Z10452 | VDAKYAKEYDDAWFEIWLLPNLTWDQQYAFIHKLNDDPSQSSELLSEAKKLNDSQAPK | 233 |
| Z10453 | VDAKYAKEMDEAWWEIWLLPNLTYAQQYAFIQKLLDDPSQSSELLSEAKKLNDSQAPK | 234 |
| Z10455 | VDAKYAKEADYAWFEIWSLPNLTHAQAYAFIVKLIDDPSQSSELLSEAKKLNDSQAPK | 235 |
| Z10456 | VDAKYAKEMDDAQWEIWMLPNLTWDQSHAFIAKLIDDPSQSSELLSEAKKLNDSQAPK | 236 |
| Z10457 | VDAKYAKEMDYAQWEIWMLPNLTWDQSNAFIRKLIDDPSQSSELLSEAKKLNDSQAPK | 237 |
| Z10458 | VDAKYAKEADYAWWEIWALPNLTHDQARAFIVKLLDDPSQSSELLSEAKKLNDSQAPK | 238 |
| Z10460 | VDAKYAKEADYAWWEIWLLPNLTWDQQRAFITKLNDDPSQSSELLSEAKKLNDSQAPK | 239 |
| Z10461 | VDAKYAKEADEAQWEIWLLPNLTYDQGTAFIRKLIDDPSQSSELLSEAKKLNDSQAPK | 240 |
| Z10464 | VDAKYAKEMDEAQWEIWLLPNLTWDQQHAFIQKLLDDPSQSSELLSEAKKLNDSQAPK | 241 |
| Z10467 | VDAKYAKEYDEAWFEIWTLPNLTHDQARAFIQKLLDDPSQSSELLSEAKKLNDSQAPK | 242 |
| Z10469 | VDAKYAKEMDRAQWEIWLLPNLTWHQQNAFIRKLIDDPSQSSELLSEAKKLNDSQAPK | 243 |
| Z10472 | VDAKYAKEHDFAWWEIWLLPNLTWDQQRAFIVKLIDDPSQSSELLSEAKKLNDSQAPK | 244 |
| Z10474 | VDAKYAKEMDQAQWEIWMLPNLTWDQQRAFIGKLLDDPSQSSELLSEAKKLNDSQAPK | 245 |
| Z10475 | VDAKYAKEADYAWFEIWMLPNLTWDQQTAFIQKLLDDPSQSSELLSEAKKLNDSQAPK | 246 |
| Z10476 | VDAKYAKEADYAWFEIWMLPNLTYDQQRAFIVKLLDDPSQSSELLSEAKKLNDSQAPK | 247 |
| Z10477 | VDAKYAKEMDRAQWEIWLLPNLTWAQSNAFIRKLIDDPSQSSELLSEAKKLNDSQAPK | 248 |
| Z10478 | VDAKYAKEADYAWFEIWMLPNLTWDQQVAFIRKLIDDPSQSSELLSEAKKLNDSQAPK | 249 |
| Z10480 | VDAKYAKEMDNAQWEIWLLPNLTWDQQNAFIRKLIDDPSQSSELLSEAKKLNDSQAPK | 250 |
| Z10481 | VDAKYAKEADEAWWEIWALPNLTYAQGRAFIVKLIDDPSQSSELLSEAKKLNDSQAPK | 251 |
| Z10482 | VDAKYAKEADFAWFEIWLLPNLTWDQQTAFIQKLLDDPSQSSELLSEAKKLNDSQAPK | 252 |
| Z10487 | VDAKYAKEMDDAQWEIWLLPNLTWDQQHAFIQKLLDDPSQSSELLSEAKKLNDSQAPK | 253 |
| Z10488 | VDAKYAKEMNEAQWEIWLLPNLTWDQQHAFIAKLIDDPSQSSELLSEAKKLNDSQAPK | 254 |
| Z10489 | VDAKYAKEMDDAQWEIWMLPNLTWDQQHAFIRKLIDDPSQSSELLSEAKKLNDSQAPK | 255 |
| Z10490 | VDAKYAKEMDYAQWEIWTLPNLTWHQGHAFIQKLLDDPSQSSELLSEAKKLNDSQAPK | 256 |
| Z10491 | VDAKYAKEYDYAWFEIWLLPNLTYAQQRAFIAKLNDDPSQSSELLSEAKKLNDSQAPK | 257 |
| Z10493 | VDAKYAKEMDQAWFEIWLLPNLTYDQQYAFIQKLLDDPSQSSELLSEAKKLNDSQAPK | 258 |
| Z10494 | VDAKYAKEMDNAQWEIWMLPNLTWDQSHAFIVKLLDDPSQSSELLSEAKKLNDSQAPK | 259 |
| Z10495 | VDAKYAKEMDYAWFEIWSLPNLTHAQAVAFIRKLNDDPSQSSELLSEAKKLNDSQAPK | 260 |

FIG. 1J

| | | |
|---|---|---|
| Z10496 | VDAKYAKEADYAWFEIWALPNLTYAQAVAFIRKLNDDPSQSSELLSEAKKLNDSQAPK | 261 |
| Z10498 | VDAKYAKEMDDAQWEIWLLPNLTWHQQNAFIAKLIDDPSQSSELLSEAKKLNDSQAPK | 262 |
| Z10499 | VDAKYAKEHDYAWFEIWMLPNLTWDQQTAFIHKLNDDPSQSSELLSEAKKLNDSQAPK | 263 |
| Z10500 | VDAKYAKEAADAWFEIWLLPNLTHAQQVAFIRKLNDDPSQSSELLSEAKKLNDSQAPK | 264 |
| Z10501 | VDAKYAKEYDYAWFEIWMLPNLTHAQAFAFIQKLNDDPSQSSELLSEAKKLNDSQAPK | 265 |
| Z10502 | VDAKYAKEYDEAWFEIWMLPNLTWDQQRAFIVKLNDDPSQSSELLSEAKKLNDSQAPK | 266 |
| Z10503 | VDAKYAKEMDDAWFEIWMLPNLTHDQAYAFIQKLIDDPSQSSELLSEAKKLNDSQAPK | 267 |
| Z10504 | VDAKYAKEMGEAQLEIWMLPNLTWDQGNAFIRKLIDDPSQSSELLSEAKKLNDSQAPK | 268 |
| Z10506 | VDAKYAKEMDDAQWEIWLLPNLTYDQGTAFIRKLIDDPSQSSELLSEAKKLNDSQAPK | 269 |
| Z10507 | VDAKYAKEAGEAWFEIWLLPNLTYDQAYAFIRKLNDDPSQSSELLSEAKKLNDSQAPK | 270 |
| Z10509 | VDAKYAKEYDDAWFEIWLLPNLTHAQAKAFIHKLNDDPSQSSELLSEAKKLNDSQAPK | 271 |
| Z10511 | VDAKYAKEADYAWFEIWMLPNLTHDQAYAFIQKLNDDPSQSSELLSEAKKLNDSQAPK | 272 |
| Z10512 | VDAKYAKEMDYAWFEIWLLPNLTYDQQYAFIQKLIDDPSQSSELLSEAKKLNDSQAPK | 273 |
| Z10513 | VDAKYAKEYDYAWFEIWTLPNLTWDQQYAFIRKLNDDPSQSSELLSEAKKLNDSQAPK | 274 |
| Z10514 | VDAKYAKEADAWFEIWLLPNLTHAQASAFIVKLNDDPSQSSELLSEAKKLNDSQAPK | 275 |
| Z10515 | VDAKYAKEMGDAQWEIWLLPNLTWHQQNAFIAKLIDDPSQSSELLSEAKKLNDSQAPK | 276 |
| Z10517 | VDAKYAKEADFAWFEIWTLPNLTWDQQRAFIVKLLDDPSQSSELLSEAKKLNDSQAPK | 277 |
| Z10518 | VDAKYAKEHDYAWFEIWMLPNLTWDQQVAFIHKLNDDPSQSSELLSEAKKLNDSQAPK | 278 |
| Z10519 | VDAKYAKEHDNAWFEIWLLPNLTYDQQVAFIHKLNDDPSQSSELLSEAKKLNDSQAPK | 279 |
| Z10520 | VDAKYAKEMDEAQWEIWMLPNLTHDQSRAFIQKLIDDPSQSSELLSEAKKLNDSQAPK | 280 |
| Z10521 | VDAKYAKEADEAWFEIWALPNLTHAQAVAFIRKLNDDPSQSSELLSEAKKLNDSQAPK | 281 |
| Z10522 | VDAKYAKEMDYAQWEIWSLPNLTWDQGNAFIRKLIDDPSQSSELLSEAKKLNDSQAPK | 282 |
| Z10523 | VDAKYAKEAAEAQLEIWMLPNLTWDQGHAFIIKLNDDPSQSSELLSEAKKLNDSQAPK | 283 |
| Z10524 | VDAKYAKEMAYAQWEIWLLPNLTWHQSNAFIHKLIDDPSQSSELLSEAKKLNDSQAPK | 284 |
| Z10525 | VDAKYAKEMDNAQWEIWMLPNLTWHQQHAFIQKLNDDPSQSSELLSEAKKLNDSQAPK | 285 |
| Z10526 | VDAKYAKEYDQAWFEIWLLPNLTWDQAYAFIQKLNDDPSQSSELLSEAKKLNDSQAPK | 286 |
| Z10527 | VDAKYAKEWDYAWFEIWELPNLTWDQQRAFIIKLNDDPSQSSELLSEAKKLNDSQAPK | 287 |
| Z10528 | VDAKYAKEADYAWFEIWSLPNLTWDQQARAFIIKLNDDPSQSSELLSEAKKLNDSQAPK | 288 |
| Z10530 | VDAKYAKEADFAQWEIWLLPNLTWDQGHAFIQKLIDDPSQSSELLSEAKKLNDSQAPK | 289 |

FIG. 1K

| | | |
|---|---|---|
| Z10535 | VDAKYAKEYDEAWFEIWLLPNLTYDQQRAFIIKLNDDPSQSSELLSEAKKLNDSQAPK | 290 |
| Z10536 | VDAKYAKEMDDAQWEIWMLPNLTWDQGHAFIRKLLDDPSQSSELLSEAKKLNDSQAPK | 291 |
| Z10537 | VDAKYAKEMDEAWWEIWTLPNLTYDQQYAFIAKLLDDPSQSSELLSEAKKLNDSQAPK | 292 |
| Z10541 | VDAKYAKEADDAQWEIWLLPNLTWDQSHAFIQKLIDDPSQSSELLSEAKKLNDSQAPK | 293 |
| Z10542 | VDAKYAKEMDDAWFEIWLLPNLTYDQQYAFIQKLIDDPSQSSELLSEAKKLNDSQAPK | 294 |
| Z10543 | VDAKYAKEMDEAQWEIWMLPNLTWAQSHAFIQKLIDDPSQSSELLSEAKKLNDSQAPK | 295 |
| Z10544 | VDAKYAKEYDFAWFEIWLLPNLTWAQQRAFISKLNDDPSQSSELLSEAKKLNDSQAPK | 296 |
| Z10545 | VDAKYAKEHANAWFEIWLLPNLTYDQQVAFIRKLNDDPSQSSELLSEAKKLNDSQAPK | 297 |
| Z10546 | VDAKYAKEYDNAWFEIWLLPNLTYDQATAFIHKLNDDPSQSSELLSEAKKLNDSQAPK | 298 |
| Z10547 | VDAKYAKEWDEAWFEIWALPNLTHAQARAFIQKLIDDPSQSSELLSEAKKLNDSQAPK | 299 |
| Z10548 | VDAKYAKEYDFAWFEIWLLPNLTYDQAVAFIQKLIDDPSQSSELLSEAKKLNDSQAPK | 300 |
| Z10549 | VDAKYAKEADYAWFEIWALPNLTHAQORAFIVKLNDDPSQSSELLSEAKKLNDSQAPK | 301 |
| Z10551 | VDAKYAKEADYAWWEIWLLPNLTYDQQRAFIVKLIKLNDDPSQSSELLSEAKKLNDSQAPK | 302 |
| Z10553 | VDAKYAKEHDYAWFEIWLLPNLTWDQQKAFIAKLIKLNDDPSQSSELLSEAKKLNDSQAPK | 303 |
| Z10554 | VDAKYAKEADEAWWEIWTLPNLTWDQQHAFIRKLIDDPSQSSELLSEAKKLNDSQAPK | 304 |
| Z10555 | VDAKYAKEMDYAQWEIWMLPNLTWDQQHAFIRKLIDDPSQSSELLSEAKKLNDSQAPK | 305 |
| Z10557 | VDAKYAKEMDFAQWEIWTLPNLTWDQGHAFISKLIDDPSQSSELLSEAKKLNDSQAPK | 306 |
| Z10558 | VDAKYAKEMGEAQIEIWLLPNLTYDQQKLIDDPSQSSELLSEAKKLNDSQAPK | 307 |
| Z10560 | VDAKYAKEADYAWFEIWALPNLTYDQQRARAFIQKLLDDPSQSSELLSEAKKLNDSQAPK | 308 |
| Z10561 | VDAKYAKEYDQAWFEIWLLPNLTYDQQRAFIVKLIKLNDDPSQSSELLSEAKKLNDSQAPK | 309 |
| Z10564 | VDAKYAKEADEAWWEIWINTLPNLTWDQQHAFIRKLIDDPSQSSELLSEAKKLNDSQAPK | 310 |
| Z10567 | VDAKYAKEMDYAQWEIWMLPNLTWDQQHAFIRKLIDDPSQSSELLSEAKKLNDSQAPK | 311 |
| Z10568 | VDAKYAKEYDFAQWEIWLLPNLTWDQSHAFIQKLIDDPSQSSELLSEAKKLNDSQAPK | 312 |
| Z10569 | VDAKYAKEADYAWFEIWLLPNLTWDQQTAFISKLNDDPSQSSELLSEAKKLNDSQAPK | 313 |
| Z10570 | VDAKYAKEMDYAQWEIWLLPNLTWHQSNAFIRKLNDDPSQSSELLSEAKKLNDSQAPK | 314 |
| Z10571 | VDAKYAKEHAEAWFEIWALPNLTWDQARAFIRKLNDDPSQSSELLSEAKKLNDSQAPK | 315 |
| Z10572 | VDAKYAKEADYAWFEIWALPNLTYDQQFAFIRKLLDDPSQSSELLSEAKKLNDSQAPK | 316 |
| Z10573 | VDAKYAKEYDNAWFEIWMLPNLTHAQAVAFIRKLNDDPSQSSELLSEAKKLNDSQAPK | 317 |
| Z10576 | VDAKYAKEADFAWWEIWLLPNLTHDQQRAFIVKLLDDPSQSSELLSEAKKLNDSQAPK | 318 |

FIG. 1L

| | | |
|---|---|---|
| Z10587 | VDAKYAKEADFAWFEIWALPNLTHDQAVAFIRKLNDDPSQSSELLSEAKKLNDSQAPK | 319 |
| Z10588 | VDAKYAKEHDYAWFEIWMLPNLTYDQAHAFIRKLNDDPSQSSELLSEAKKLNDSQAPK | 320 |
| Z10589 | VDAKYAKEADEAWWEIWLLPNLTYDQQHAFIVKLIDDPSQSSELLSEAKKLNDSQAPK | 321 |
| Z10590 | VDAKYAKEMDYAWWEIWLLPNLTHDQAYAFIVKLLDDPSQSSELLSEAKKLNDSQAPK | 322 |
| Z10592 | VDAKYAKEYLYAWFEIWTLPNLTYDQQVAFIRKLLDDPSQSSELLSEAKKLNDSQAPK | 323 |
| Z10593 | VDAKYAKEYDDAWFEIWTLPNLTRDQQTAFIIKLNDDPSQSSELLSEAKKLNDSQAPK | 324 |
| Z10594 | VDAKYAKEMDEAWFEIWSLPNLTYAQQYAFIVKLIDDPSQSSELLSEAKKLNDSQAPK | 325 |
| Z10596 | VDAKYAKEADYAWFEIWSLPNLTHVQQVAFIRKLLDDPSQSSELLSEAKKLNDSQAPK | 326 |
| Z10599 | VDAKYAKEADEAWFEIWSLPNLTHAQARAFIQKLLDDPSQSSELLSEAKKLNDSQAPK | 327 |
| Z10603 | VDAKYAKEYDEAWFEIWMLPNLTRDQASAFIIKLNDDPSQSSELLSEAKKLNDSQAPK | 328 |
| Z10605 | VDAKYAKEHADAWFEIWSLPNLTHVQARAFIIKLNDDPSQSSELLSEAKKLNDSQAPK | 329 |
| Z10606 | VDAKYAKEADFAWFEIWSLPNLTHAQTAFIRKLLDDPSQSSELLSEAKKLNDSQAPK | 330 |
| Z10610 | VDAKYAKEADYAWFEIWSLPNLTHAQATAFISKLNDDPSQSSELLSEAKKLNDSQAPK | 331 |
| Z10611 | VDAKYAKEYDYAWFEIWELPNLTWDQQTAFIRKLNDDPSQSSELLSEAKKLNDSQAPK | 332 |
| Z10612 | VDAKYAKEADYAWFEIWLLPNLTHDQATAFIRKLIDDPSQSSELLSEAKKLNDSQAPK | 333 |
| Z10613 | VDAKYAKEADYAWWEIWLLPNLTHDQANAFIRKLIDDPSQSSELLSEAKKLNDSQAPK | 334 |
| Z10614 | VDAKYAKEADFAWWEIWSLPNLTHDQQVAFIRKLNDDPSQSSELLSEAKKLNDSQAPK | 335 |
| Z10615 | VDAKYAKEADYAWFEIWALPNLTHVQQVAFIRKLNDDPSQSSELLSEAKKLNDSQAPK | 336 |
| Z10620 | VDAKYAKEADYAWFEIWALPNLTHAQVAFIAKLNDDPSQSSELLSEAKKLNDSQAPK | 337 |
| Z10623 | VDAKYAKEADEAWQEIWLLPNLTHHQANAFIRKLISDPSQSSELLSEAKKLNDSQAPK | 338 |
| Z10624 | VDAKYAKEMDEAQWEIWLLPNLTHDQQAKAFIGKLNDDPSQSSELLSEAKKLNDSQAPK | 339 |
| Z10625 | VDAKYAKEADYAWWEIWLLPNLTHDQQVAFIQKLLDDPSQSSELLSEAKKLNDSQAPK | 340 |
| Z10628 | VDAKYAKEADQAWWEIWLLPNLTHDQQVAFIRKLIDDPSQSSELLSEAKKLNDSQAPK | 341 |
| Z10632 | VDAKYAKEADYAWWEIWSLPNLTHVQQVAFIRKLIDDPSQSSELLSEAKKLNDSQAPK | 342 |
| Z10633 | VDAKYAKEHGYAWFEIWALPNLTHDQAKAFIGKLNDDPSQSSELLSEAKKLNDSQAPK | 343 |
| Z10634 | VDAKYAKEYDEAWFEIWMLPNLFTYDQGRAFIGKLNDDPSQSSELLSEAKKLNDSQAPK | 344 |
| Z10636 | VDAKYAKEADFAWWEIWSLPNLTHVQAVAFIRKLLDDPSQSSELLSEAKKLNDSQAPK | 345 |
| Z10637 | VDAKYAKEADDAWFEIWALPNLTHAQAVAFIQKLNDDPSQSSELLSEAKKLNDSQAPK | 346 |
| Z10639 | VDAKYAKEADDAWFEIWALPNLTHAQAVAFIQKLNDDPSQSSELLSEAKKLNDSQAPK | 347 |

FIG. 1M

| | | |
|---|---|---|
| Z10640 | VDAKYAKEADQAWWEIWALPNLTHDQGVAFIRKLLDDPSQSSELLSEAKKLNDSQAPK | 348 |
| Z10641 | VDAKYAKEYDEAWFEIWLLPNLTADQARAFIVKLNDDPSQSSELLSEAKKLNDSQAPK | 349 |
| Z10644 | VDAKYAKEADYAWWEIWALPNLTYDQQYAFIRKLNDDPSQSSELLSEAKKLNDSQAPK | 350 |
| Z10645 | VDAKYAKEADDAWWEIWMLPNLTHDQARAFIQKLLDDPSQSSELLSEAKKLNDSQAPK | 351 |
| Z10646 | VDAKYAKEADEAWWEIWALPNLTHRQQVAFIQKLLDDPSQSSELLSEAKKLNDSQAPK | 352 |
| Z10647 | VDAKYAKEADFAWFEIWALPNLTHDQATAFIVKLNDDPSQSSELLSEAKKLNDSQAPK | 353 |
| Z10651 | VDAKYAKEMDDAWWEIWALPNLTHAQAVAFIRKLLDDPSQSSELLSEAKKLNDSQAPK | 354 |
| Z10653 | VDAKYAKEADEAWWEIWALPNLTHHQAVAFIRKLLDDPSQSSELLSEAKKLNDSQAPK | 355 |
| Z10654 | VDAKYAKEADYAWWEIWTLPNLTHDQQYAFIRKLNDDPSQSSELLSEAKKLNDSQAPK | 356 |
| Z10655 | VDAKYAKEMDFAQWEIWLLPNLTWHQSNAFIRKLLDDPSQSSELLSEAKKLNDSQAPK | 357 |
| Z10657 | VDAKYAKEWDEAWFEIWSLPNLTYDQGRAFIIKLNDDPSQSSELLSEAKKLNDSQAPK | 358 |
| Z10658 | VDAKYAKEADEAQWEIWLLPNLTHDQSNAFIRKLIDDPSQSSELLSEAKKLNDSQAPK | 359 |
| Z10659 | VDAKYAKEADEAQWEIWLLPNLTHAQQKAFIRKLLDDPSQSSELLSEAKKLNDSQAPK | 360 |
| Z10660 | VDAKYAKEMDEAQWEIWMLPNLTHDQSHAFIAKLLDDPSQSSELLSEAKKLNDSQAPK | 361 |
| Z10661 | VDAKYAKEADYAWWEIWSLPNLTHDQQVAFIRKLLDDPSQSSELLSEAKKLNDSQAPK | 362 |
| Z10662 | VDAKYAKEMDDAWWEIWLLPNLTYDQQYAFIQKLLDDPSQSSELLSEAKKLNDSQAPK | 363 |
| Z10665 | VDAKYAKEMDDAQWEIWLLPNLTWVQQNAFIRKLIDDPSQSSELLSEAKKLNDSQAPK | 364 |
| Z10666 | VDAKYAKEMDEAQWEIWLLPNLTWHQQNAFIRKLIDDPSQSSELLSEAKKLNDSQAPK | 365 |
| Z10667 | VDAKYAKEHDYAWFEIWALPNLTHAQAVAFIRKLNDDPSQSSELLSEAKKLNDSQAPK | 366 |
| Z10669 | VDAKYAKEADFAWWEIWLLPNLTYDQQHAFIVKLLDDPSQSSELLSEAKKLNDSQAPK | 367 |
| Z10670 | VDAKYAKEMLDAQWEIWMLPNLTWDQGHAFIVKLIDDPSQSSELLSEAKKLNDSQAPK | 368 |
| Z10671 | VDAKYAKEMDNAWFEIWTLPNLTYAQQHAFIVKLIDDPSQSSELLSEAKKLNDSQAPK | 369 |
| Z10672 | VDAKYAKEADYAWFEIWTLPNLTFYDQQKAFIQKLIDDPSQSSELLSEAKKLNDSQAPK | 370 |
| Z10677 | VDAKYAKEMDEAQIEIWLLPNLTWHQGNAFIQKLIDDPSQSSELLSEAKKLNDSQAPK | 371 |
| Z10678 | VDAKYAKEMDNAQWEIWLLPNLTYDQSHAFIAKLLDDPSQSSELLSEAKKLNDSQAPK | 372 |
| Z10679 | VDAKYAKEADFAWFEIWSLPNLTHDQQHAFIAKLLDDPSQSSELLSEAKKLNDSQAPK | 373 |
| Z10683 | VDAKYAKEMDYAQWEIWMLPNLTWDQQTAFISKLIDDPSQSSELLSEAKKLNDSQAPK | 374 |
| Z10685 | VDAKYAKEMDYAWFEIWMLPNLTWDQQTAFIRKLIDDPSQSSELLSEAKKLNDSQAPK | 375 |
| Z10687 | VDAKYAKEMDYAQWEIWLLPNLTHAQGTAFIRKLIDDPSQSSELLSEAKKLNDSQAPK | 376 |

FIG. 1N

| ID | Sequence | # |
|---|---|---|
| Z10689 | VDAKYAKEMDYAWFEIWALPNLTYDQAHAFIKLIDDPSQSSELLSEAKKLNDSQAPK | 377 |
| Z10691 | VDAKYAKEMDEAWWEIWTLPNLTYDQQHAFTVKLLDDPSQSSELLSEAKKLNDSQAPK | 378 |
| Z10696 | VDAKYAKEADQAWWEIWLLPNLTHDQQVAFIRKLLDDPSQSSELLSEAKKLNDSQAPK | 379 |
| Z10697 | VDAKYAKEADEAWWEIWALPNLTHDQAKAFIIKLLDDPSQSSELLSEAKKLNDSQAPK | 380 |
| Z10698 | VDAKYAKEAAEAWFEIWMLPNLTYDQAVAFIHKLIDDPSQSSELLSEAKKLNDSQAPK | 381 |
| Z10699 | VDAKYAKEADYAWFEIWLLPNLTHVQQRAFIQKLIDDPSQSSELLSEAKKLNDSQAPK | 382 |
| Z10700 | VDAKYAKEMDQAWFEIWALPNLTWHQARAFIVKLIDDPSQSSELLSEAKKLNDSQAPK | 383 |
| Z10701 | VDAKYAKEHDEAWFEIWSLPNLTYDQQRAFIIKLNDDPSQSSELLSEAKKLNDSQAPK | 384 |
| Z10702 | VDAKYAKEYDEAWFEIWMLPNLTYDQAVAFISKLNDDPSQSSELLSEAKKLNDSQAPK | 385 |
| Z10704 | VDAKYAKEHDQAWFEIWLLPNLTYAQARAFISKLNDDPSQSSELLSEAKKLNDSQAPK | 386 |
| Z10705 | VDAKYAKEMDFAQWEIWLLPNLTWHQSNAFIQKLIDDPSQSSELLSEAKKLNDSQAPK | 387 |
| Z10706 | VDAKYAKEMDFAQWEIWMLPNLTWDQSNAFIQKLIDDPSQSSELLSEAKKLNDSQAPK | 388 |
| Z10707 | VDAKYAKEMDNAQWEIWLLPNLTWAQQNAFIRKLIDDPSQSSELLSEAKKLNDSQAPK | 389 |
| Z10709 | VDAKYAKEMDYAWFEIWMLPNLTYDQAFAFIQKLIDDPSQSSELLSEAKKLNDSQAPK | 390 |
| Z10711 | VDAKYAKEMDYAQWEIWLLPNLTWVQSHAFIQKLIDDPSQSSELLSEAKKLNDSQAPK | 391 |
| Z10713 | VDAKYAKEADFAWWEIWALPNLTHVQAKAFIQKLIDDPSQSSELLSEAKKLNDSQAPK | 392 |
| Z10715 | VDAKYAKEMDYAQWEIWLLPNLTWDQSHAFITVKLLDDPSQSSELLSEAKKLNDSQAPK | 393 |
| Z10716 | VDAKYAKEADFAWWEIWLLPNLTHDQAYAFIVKLIDDPSQSSELLSEAKKLNDSQAPK | 394 |
| Z10717 | VDAKYAKEMDNAQWEIWLLPNLTYAQQHAFIIKLLDDPSQSSELLSEAKKLNDSQAPK | 395 |
| Z10719 | VDAKYAKEADYAWWEIWSLPNLTHVQARAFIKLLDDPSQSSELLSEAKKLNDSQAPK | 396 |
| Z10720 | VDAKYAKEHDEAWFEIWTLPNLTHAQARAFISKLNDDPSQSSELLSEAKKLNDSQAPK | 397 |
| Z10724 | VDAKYAKEADYAWFEIWLLPNLTYDQQYAFIQKLNDDPSQSSELLSEAKKLNDSQAPK | 398 |
| Z10725 | VDAKYAKEMDRAQWEIWLLPNLTWDQSHAFIQKLIDDPSQSSELLSEAKKLNDSQAPK | 399 |
| Z10726 | VDAKYAKEMDEAWWEIWLLPNLTYDQAFIAKLIDDPSQSSELLSEAKKLNDSQAPK | 400 |
| Z10727 | VDAKYAKEYDYAWFEIWLLPNLTYDQQYAFIHKLNDDPSQSSELLSEAKKLNDSQAPK | 401 |
| Z10735 | VDAKYAKEADFAWFEIWSLPNLTWHQQRAFIHKLNDDPSQSSELLSEAKKLNDSQAPK | 402 |
| Z10736 | VDAKYAKEADFAWFEIWLLPNLTWDQQKAFIHKLNDDPSQSSELLSEAKKLNDSQAPK | 403 |
| Z10737 | VDAKYAKEMDQAVFEIWLLPNLTWAQQVAFIQKLNDDPSQSSELLSEAKKLNDSQAPK | 404 |
| Z10738 | VDAKYAKEMDDAQWEIWLLPNLTWDQQHAFIAKLNDDPSQSSELLSEAKKLNDSQAPK | 405 |

FIG. 10

| | | |
|---|---|---|
| Z10739 | VDAKYAKEMDEAQWEIWLLPNLTWDQGHAFIQKLLDDPSQSSELLSEAKKLNDSQAPK | 406 |
| Z10741 | VDAKYAKEADYAWFEIWMLPNLTHDQQYAFIHKLLNDDPSQSSELLSEAKKLNDSQAPK | 407 |
| Z10742 | VDAKYAKEADYAWFEIWALPNLTHVQQVAFIHKLLNDDPSQSSELLSEAKKLNDSQAPK | 408 |
| Z10747 | VDAKYAKEADYAWWEIWALPNLTHAQQVAFIRKLLDDPSQSSELLSEAKKLNDSQAPK | 409 |
| Z10749 | VDAKYAKEMGQAQLEIWMLPNLTWDQGHAFIQKLIDDPSQSSELLSEAKKLNDSQAPK | 410 |
| Z10750 | VDAKYAKEMDEAQWEIWLLPNLTWHQSHAFISKLIDDPSQSSELLSEAKKLNDSQAPK | 411 |
| Z10751 | VDAKYAKEMDYAQWEIWLLPNLTWHQQHAFIVKLLDDPSQSSELLSEAKKLNDSQAPK | 412 |
| Z10755 | VDAKYAKEADEAQWEIWLLPNLTWDQSNAFIRKLIDDPSQSSELLSEAKKLNDSQAPK | 413 |
| Z10758 | VDAKYAKEYDYAWFEIWLLPNLTRDQQRAFIKLNDDPSQSSELLSEAKKLNDSQAPK | 414 |
| Z10761 | VDAKYAKEHAEAWFEIWALPNLTWQARAFIVKLNDDPSQSSELLSEAKKLNDSQAPK | 415 |
| Z10762 | VDAKYAKEADYAWFEIWLLPNLTYHQQVAFIHKLLNDDPSQSSELLSEAKKLNDSQAPK | 416 |
| Z10764 | VDAKYAKEYDFAWFEIWLLPNLTWDQQVAFISKLNDDPSQSSELLSEAKKLNDSQAPK | 417 |
| Z10765 | VDAKYAKEMDEAQWEIWLLPNLTWDQSNAFIRKLIDDPSQSSELLSEAKKLNDSQAPK | 418 |
| Z10767 | VDAKYAKEMDEAQIEIWLLPNLTWAQGHAFIQKLLDDPSQSSELLSEAKKLNDSQAPK | 419 |
| Z10768 | VDAKYAKEADYAWFEIWLLPNLTHQQYAFIQKLNDDPSQSSELLSEAKKLNDSQAPK | 420 |
| Z10769 | VDAKYAKEMDEAQWEIWLLPNLTWDQFAFIRKLNDDPSQSSELLSEAKKLNDSQAPK | 421 |
| Z10770 | VDAKYAKEYDQAWFEIWLLPNLTYAQQFAFIRKLIDDPSQSSELLSEAKKLNDSQAPK | 422 |
| Z10777 | VDAKYAKEMGEAQLEIWLLPNLTWHQQNAFIRKLIDDPSQSSELLSEAKKLNDSQAPK | 423 |
| Z10782 | VDAKYAKEMDYAQWEIWLLPNLTYDQQHAFIVKLLDDPSQSSELLSEAKKLNDSQAPK | 424 |
| Z10786 | VDAKYAKEMDEAWWEIWLLPNLTYAQGRAFIKLLDDPSQSSELLSEAKKLNDSQAPK | 425 |
| Z10787 | VDAKYAKEMDEAWWEIWLLPNLTYDQQYAFISKLIDDPSQSSELLSEAKKLNDSQAPK | 426 |
| Z10794 | VDAKYAKEYDYAWFEIWMLPNLTYDQQVAFISKLNDDPSQSSELLSEAKKLNDSQAPK | 427 |
| Z10796 | VDAKYAKEMDEAQWEIWMLPNLTYDQQNAFISHAFIQKLLDDPSQSSELLSEAKKLNDSQAPK | 428 |
| Z10797 | VDAKYAKEMDFAQWEIWMLPNLTWDQSHAFIQKLIDDPSQSSELLSEAKKLNDSQAPK | 429 |
| Z10798 | VDAKYAKEYDYAWFEIWALPNLTYDQQHAFIVKLNDDPSQSSELLSEAKKLNDSQAPK | 430 |
| Z10802 | VDAKYAKEADFAWWEIWALPNLTHDQARAFIVKLLDDPSQSSELLSEAKKLNDSQAPK | 431 |
| Z10804 | VDAKYAKEMDYAQWEIWLLPNLTYDQATAFISKLNDDPSQSSELLSEAKKLNDSQAPK | 432 |
| Z10806 | VDAKYAKEMDYAQWEIWLLPNLTHDQGRAFIQKLIDDPSQSSELLSEAKKLNDSQAPK | 433 |
| Z10808 | VDAKYAKEMDEAQWEIWLLPNLTWDQGNAFISKLIDDPSQSSELLSEAKKLNDSQAPK | 434 |

FIG. 1P

| ID | Sequence | # |
|---|---|---|
| Z10809 | VDAKYAKEADYAWWEIWSLPNLTHAQAYAFIVKLIDDPSQSSELLSEAKKLNDSQAPK | 435 |
| Z10810 | VDAKYAKEYDNAWFEIWALPNLTYAQAYAFIRKLNDDPSQSSELLSEAKKLNDSQAPK | 436 |
| Z10812 | VDAKYAKEMDEAQWEIWMLPNLTYAQSHAFIVKLIDDPSQSSELLSEAKKLNDSQAPK | 437 |
| Z10813 | VDAKYAKEADYAWFEIWMLPNLTRDQATAFIKLNDDPSQSSELLSEAKKLNDSQAPK | 438 |
| Z10814 | VDAKYAKEADYAWFEIWALPNLTWHQATAFIKLNDDPSQSSELLSEAKKLNDSQAPK | 439 |
| Z10815 | VDAKYAKEADYAWFEIWALPNLTWDQQRAFISKLNDDPSQSSELLSEAKKLNDSQAPK | 440 |
| Z10816 | VDAKYAKEADYAWWEIWTLPNLTYDQSRAFIVKLLDDPSQSSELLSEAKKLNDSQAPK | 441 |
| Z10817 | VDAKYAKEADYAWFEIWELPNLTHDQAVAFIRKLNDDPSQSSELLSEAKKLNDSQAPK | 442 |
| Z10818 | VDAKYAKEMDEAQWEIWLLPNLTHDQGRAFIQKLIDDPSQSSELLSEAKKLNDSQAPK | 443 |
| Z10819 | VDAKYAKEMDNAQWEIWLLPNLTWHQSNAFIQKLIDDPSQSSELLSEAKKLNDSQAPK | 444 |
| Z10821 | VDAKYAKEMDDAQWEIWLLPNLTWHQSNAFIRKLIDDPSQSSELLSEAKKLNDSQAPK | 445 |
| Z10822 | VDAKYAKEMDFAQWEIWLLPNLTWHQQHAFIVKLLDDPSQSSELLSEAKKLNDSQAPK | 446 |
| Z10823 | VDAKYAKEHGYAWFEIWALPNLTWDQQVAFIIKLNDDPSQSSELLSEAKKLNDSQAPK | 447 |
| Z10824 | VDAKYAKEMDYAQWEIWLLPNLTWAQSNAFIAKLIDDPSQSSELLSEAKKLNDSQAPK | 448 |
| Z10825 | VDAKYAKEMDEAQWEIWMLPNLTWHQSHAFIVKLLDDPSQSSELLSEAKKLNDSQAPK | 449 |
| Z10826 | VDAKYAKEMDFAQWEIWLLPNLTWVQSNAFIRKLIDDPSQSSELLSEAKKLNDSQAPK | 450 |
| Z10827 | VDAKYAKEMDNAQWEIWLLPNLTHDQGNAFIRKLIDDPSQSSELLSEAKKLNDSQAPK | 451 |
| Z10830 | VDAKYAKEYDYAWFEIWLLPNLTWDQATAFIRKLNDDPSQSSELLSEAKKLNDSQAPK | 452 |
| Z10831 | VDAKYAKEMDEAQWEIWLLPNLTYDQQHAFIIKLDDPSQSSELLSEAKKLNDSQAPK | 453 |
| Z10832 | VDAKYAKEMDQAQWEIWLLPNLTWDQQRAFIVKLIDDPSQSSELLSEAKKLNDSQAPK | 454 |
| Z10833 | VDAKYAKEMDEAQWEIWLLPNLTWHQSHAFIQKLLDDPSQSSELLSEAKKLNDSQAPK | 455 |
| Z10834 | VDAKYAKEYDQAWFEIWLLPNLTWDQAVAFIIKLNDDPSQSSELLSEAKKLNDSQAPK | 456 |
| Z10835 | VDAKYAKEMGDAQWEIWLLPNLTWAQQNAFIRKLIDDPSQSSELLSEAKKLNDSQAPK | 457 |
| Z10836 | VDAKYAKEMDEAQWEIWLLPNLTWAQGHAFISKLLDDPSQSSELLSEAKKLNDSQAPK | 458 |
| Z10837 | VDAKYAKEMDDAQWEIWTLPNLTWHQQNAFIRKLNDDPSQSSELLSEAKKLNDSQAPK | 459 |
| Z10838 | VDAKYAKEADDAWWEIWALPNLTWDQARAFIVKLLDDPSQSSELLSEAKKLNDSQAPK | 460 |
| Z10840 | VDAKYAKEMDFAQWEIWLLPNLTWDQGHAFISKLLDDPSQSSELLSEAKKLNDSQAPK | 461 |
| Z10842 | VDAKYAKEMDFAWFEIWALPNLTYDQQVAFIRKLIDDPSQSSELLSEAKKLNDSQAPK | 462 |
| Z10843 | VDAKYAKEWDEAWFEIWALPNLTYDQAVAFIHKLNDDPSQSSELLSEAKKLNDSQAPK | 463 |

FIG. 1Q

| | | |
|---|---|---|
| Z10846 | VDAKYAKEMDNAQWEIWLLPNLTWDQSHAFIVKLLDDPSQSSELLSEAKKLNDSQAPK | 464 |
| Z10847 | VDAKYAKEYDDAWFEIWTLPNLTYVQQYAFIRKLNDDPSQSSELLSEAKKLNDSQAPK | 465 |
| Z10848 | VDAKYAKEHAEAWFEIWSLPNLTWDQQVAFIGKLNDDPSQSSELLSEAKKLNDSQAPK | 466 |
| Z10849 | VDAKYAKEMGEAQWEIWLLPNLTYDQSHAFIVKLLDDPSQSSELLSEAKKLNDSQAPK | 467 |
| Z10850 | VDAKYAKEHDYAWFEIWALPNLTHDQARAFIHKLNDDPSQSSELLSEAKKLNDSQAPK | 468 |
| Z10851 | VDAKYAKEADYAWFEIWALPNLTWDQQRAFIVKLNDDPSQSSELLSEAKKLNDSQAPK | 469 |
| Z10854 | VDAKYAKEADYAWFEIWSLPNLTYHQARAFIQKLIDDPSQSSELLSEAKKLNDSQAPK | 470 |
| Z10855 | VDAKYAKEMDRAQLEIWLLPNLTWAQGNAFIRKLIDDPSQSSELLSEAKKLNDSQAPK | 471 |
| Z10856 | VDAKYAKEHAEAWFEIWLLPNLTYDQAVAFIGKLNDDPSQSSELLSEAKKLNDSQAPK | 472 |
| Z10860 | VDAKYAKEMNQAQWEIWLLPNLTWHQSHAFIQKLLDDPSQSSELLSEAKKLNDSQAPK | 473 |
| Z10862 | VDAKYAKEHAEAWFEIWLLPNLTWRQRAFIHKLNDDPSQSSELLSEAKKLNDSQAPK | 474 |
| Z10864 | VDAKYAKEMDQAQWEIWLLPNLTWDQSHAFISKLLDDPSQSSELLSEAKKLNDSQAPK | 475 |
| Z10871 | VDAKYAKEMDEAQWEIWLLPNLTHAQSHAFIQKLIDDPSQSSELLSEAKKLNDSQAPK | 476 |
| Z10873 | VDAKYAKEMDEAQWEIWLLPNLTWHQGNAFIQKLLDDPSQSSELLSEAKKLNDSQAPK | 477 |
| Z10874 | VDAKYAKEMDEAWWEIWLLPNLTYDQQRAFIVKLLDDPSQSSELLSEAKKLNDSQAPK | 478 |
| Z10876 | VDAKYAKEYDYAWFEIWLLPNLTHAQARAFIHKLNDDPSQSSELLSEAKKLNDSQAPK | 479 |
| Z10884 | VDAKYAKEHAEAWFEIWMLPNLTWAQQRAFIGKLNDDPSQSSELLSEAKKLNDSQAPK | 480 |
| Z10885 | VDAKYAKEMDDAQWEIWLLPNLTWDQSHAFIAKLIDDPSQSSELLSEAKKLNDSQAPK | 481 |
| Z10888 | VDAKYAKEYDEAWFEIWALPNLTHAQAVAFIRKLNDDPSQSSELLSEAKKLNDSQAPK | 482 |
| Z10890 | VDAKYAKEYDFAWFEIWLLPNLTWDQQRAFISKLNDDPSQSSELLSEAKKLNDSQAPK | 483 |
| Z10894 | VDAKYAKEMDEAQWEIWLLPNLTWHQAHAFIRKLIDDPSQSSELLSEAKKLNDSQAPK | 484 |
| Z10898 | VDAKYAKEHDFAWFEIWLLPNLTWDQQVAFIHKLNDDPSQSSELLSEAKKLNDSQAPK | 485 |
| Z10902 | VDAKYAKEWDEAQWEIWMLPNLTWDQSHAFIQKLIDDPSQSSELLSEAKKLNDSQAPK | 486 |
| Z10907 | VDAKYAKEMGRAQIEIWLLPNLTWDQGNAFIRKLIDDPSQSSELLSEAKKLNDSQAPK | 487 |
| Z10917 | VDAKYAKEADYAWFEIWMLPNLTYDQQYAFIRKLNDDPSQSSELLSEAKKLNDSQAPK | 488 |
| Z10919 | VDAKYAKEMDDAQWEIWMLPNLTHDQAKAFIVKLNDDPSQSSELLSEAKKLNDSQAPK | 489 |
| Z10920 | VDAKYAKEADYAWFEIWTLPNLTWHQSNAFIRKLLDDPSQSSELLSEAKKLNDSQAPK | 490 |
| Z10925 | VDAKYAKEMDEAQWEIWLLPNLTWVQQNAFIRKLIDDPSQSSELLSEAKKLNDSQAPK | 491 |
| Z10927 | VDAKYAKEMDYAQWEIWLLPNLTWQQNAFIRKLIDDPSQSSELLSEAKKLNDSQAPK | 492 |

FIG. 1R

| ID | Sequence | # |
|---|---|---|
| Z10935 | VDAKYAKEADYAWWEIWALPNLTHDQAVAFIRKLIDDPSQSSELLSEAKKLNDSQAPK | 493 |
| Z10938 | VDAKYAKEADYAWFEIWALPNLTHRQQVAFIRKLNDDPSQSSELLSEAKKLNDSQAPK | 494 |
| Z10942 | VDAKYAKEMDQAQWEIWLLPNLTWHQHAFIRKLIDDPSQSSELLSEAKKLNDSQAPK | 495 |
| Z10945 | VDAKYAKEMNEAQLEIWLLPNLTWAQGHAFIQKLIDDPSQSSELLSEAKKLNDSQAPK | 496 |
| Z10952 | VDAKYAKEADEAWWEIWALPNLTHHQAVAFIRKLIDDPSQSSELLSEAKKLNDSQAPK | 497 |
| Z10954 | VDAKYAKEYDYAWFEIWLLPNLTYRQARAFIIKLNDDPSQSSELLSEAKKLNDSQAPK | 498 |
| Z10961 | VDAKYAKEMGEAQWEIWLLPNLTWDQQHAFIQKLIDDPSQSSELLSEAKKLNDSQAPK | 499 |
| Z10962 | VDAKYAKEYDAWFEIWLLPNLTADQQRAFIHKLNDDPSQSSELLSEAKKLNDSQAPK | 500 |
| Z10963 | VDAKYAKEHDEAWFEIWLLPNLTWDQQVAFIRKLNDDPSQSSELLSEAKKLNDSQAPK | 501 |
| Z10971 | VDAKYAKEYDDAWFEIWLLPNLTWAQQRAFISKLNDDPSQSSELLSEAKKLNDSQAPK | 502 |
| Z10973 | VDAKYAKEYDEAWFEIWLLPNLTRDQGKAFIHKLNDDPSQSSELLSEAKKLNDSQAPK | 503 |
| Z10979 | VDAKYAKEYDDAWFEIWLLPNLTHAQARAFIVKLLDDPSQSSELLSEAKKLNDSQAPK | 504 |
| Z10986 | VDAKYAKEHAEAWFEIWLLPNLTYRQQVAFISKLNDDPSQSSELLSEAKKLNDSQAPK | 505 |
| Z10988 | VDAKYAKEMDEAWFEIWMLPNLTRDQAVAFIGKLNDDPSQSSELLSEAKKLNDSQAPK | 506 |
| Z10990 | VDAKYAKEMDEAQWEIWLLPNLTWHQQKAFIQKLIDDPSQSSELLSEAKKLNDSQAPK | 507 |
| Z10992 | VDAKYAKEADYAWFEIWMLPNLTYAQQRAFIVKLLDDPSQSSELLSEAKKLNDSQAPK | 508 |
| Z11015 | VDAKYAKEMDEAQWEIWLLPNLTHAQQRAFIQKLIDDPSQSSELLSEAKKLNDSQAPK | 509 |
| Z11017 | VDAKYAKEMDYAQWEIWLLPNLTWHQSNAFIQKLIDDPSQSSELLSEAKKLNDSQAPK | 510 |
| Z11021 | VDAKYAKEMDEAQWEIWLLPNLTYAQSRAFIVKLIDDPSQSSELLSEAKKLNDSQAPK | 511 |
| Z11027 | VDAKYAKEMDYAQWEIWLLPNLTWDQSRAFIVKLIDDPSQSSELLSEAKKLNDSQAPK | 512 |
| Z11030 | VDAKYAKEMDQAQWEIWLLPNLTYDQGRAFIQKLIDDPSQSSELLSEAKKLNDSQAPK | 513 |
| Z11045 | VDAKYAKEMDYAQWEIWLLPNLTHDQSRAFISKLIDDPSQSSELLSEAKKLNDSQAPK | 514 |
| Z11052 | VDAKYAKEMDEAQWEIWMLPNLTHAQSRAFIQKLIDDPSQSSELLSEAKKLNDSQAPK | 515 |
| Z11063 | VDAKYAKEMDEAWWEIWTLPNLTYDQARAFIVKLIDDPSQSSELLSEAKKLNDSQAPK | 516 |
| Z11069 | VDAKYAKEADYAWFEIWTLPNLTRDQARAFTHKLNDDPSQSSELLSEAKKLNDSQAPK | 517 |
| Z11085 | VDAKYAKEMDNAQWEIWLLPNLTWDQSRAFIVKLIDDPSQSSELLSEAKKLNDSQAPK | 518 |
| Z11086 | VDAKYAKEMDNAQWEIWLLPNLTWDQWYAFIQKLIDDPSQSSELLSEAKKLNDSQAPK | 519 |
| Z12058 | VDAKYAKEADDAAYEIAFLPNLTWDQWYAFIQKLRDDPSQSSELLSEAKKLNDSQAPK | 520 |
| Z12061 | VDAKYAKEADLAAVEIAELPNLTWDQWWAFIQKLRDDPSQSSELLSEAKKLNDSQAPK | 521 |

FIG. 1S

| | | |
|---|---|---|
| Z12062 | VDAKYAKEADDAALEIADLPNLTWEQWYAFISKLRDDPSQSSELLSEAKKLNDSQAPK | 522 |
| Z12064 | VDAKYAKEADQAAYEIAYLPNLTWDQWFAFIEKLRDDPSQSSELLSEAKKLNDSQAPK | 523 |
| Z12065 | VDAKYAKEADQAAVEIADLPNLTWDQWWAFISKLRDDPSQSSELLSEAKKLNDSQAPK | 524 |
| Z12066 | VDAKYAKEADEAAMEIADLPNLTWDQWFAFIEKLRDDPSQSSELLSEAKKLNDSQAPK | 525 |
| Z12067 | VDAKYAKEADMAAFEIALLPNLTWDQWEAFIGKLRDDPSQSSELLSEAKKLNDSQAPK | 526 |
| Z12068 | VDAKYAKEADDAAVEIADLPNLTWDQWWAFIRKLRDDPSQSSELLSEAKKLNDSQAPK | 527 |
| Z12069 | VDAKYAKEADDAAVEIAELPNLTWEQWYAFIDKLRDDPSQSSELLSEAKKLNDSQAPK | 528 |
| Z12070 | VDAKYAKEADEAAVEIAALPNLTWDQWFAFIDKLRDDPSQSSELLSEAKKLNDSQAPK | 529 |
| Z12071 | VDAKYAKEADEAAYEIAFLPNLTWDQWYAFITKLRDDPSQSSELLSEAKKLNDSQAPK | 530 |
| Z12072 | VDAKYAKEADNAALEIADLPNLTWDQWYAFIAKLRDDPSQSSELLSEAKKLNDSQAPK | 531 |
| Z12074 | VDAKYAKEADDAAVEIANLPNLTWDQWWAFITKLRDDPSQSSELLSEAKKLNDSQAPK | 532 |
| Z12075 | VDAKYAKEADEAAYEIAFLPNLTWDQWFAFINKLRDDPSQSSELLSEAKKLNDSQAPK | 533 |
| Z12076 | VDAKYAKEADDAALEIADLPNLTWDQWIAFINKLRDDPSQSSELLSEAKKLNDSQAPK | 534 |
| Z12079 | VDAKYAKEADNAAMEIADLPNLTWDQWFAFINKLRDDPSQSSELLSEAKKLNDSQAPK | 535 |
| Z12080 | VDAKYAKEADDAAFEIAFLPNLTWDQWWAFINKLRDDPSQSSELLSEAKKLNDSQAPK | 536 |
| Z12082 | VDAKYAKEADDAAMEIAELPNLTWDQWYAFIEKLRDDPSQSSELLSEAKKLNDSQAPK | 537 |
| Z12083 | VDAKYAKEADDAAVEIAYLPNLTWDQWFAFIDKLRDDPSQSSELLSEAKKLNDSQAPK | 538 |
| Z12084 | VDAKYAKEADSAAVEIADLPNLTWDQWYAFINKLRDDPSQSSELLSEAKKLNDSQAPK | 539 |
| Z12085 | VDAKYAKEADEAAYEIAFLPNLTWDQWAAFIEKLRDDPSQSSELLSEAKKLNDSQAPK | 540 |
| Z12086 | VDAKYAKEADMAAMEIADLPNLTWDQWYAFIWKLRDDPSQSSELLSEAKKLNDSQAPK | 541 |
| Z12087 | VDAKYAKEADDAAVEIAYLPNLTWDQWWAFIQKLRDDPSQSSELLSEAKKLNDSQAPK | 542 |
| Z12088 | VDAKYAKEADEAAMEIADLPNLTWDQWFAFILKLRDDPSQSSELLSEAKKLNDSQAPK | 543 |
| Z12089 | VDAKYAKEADEAAVEIADLPNLTWDQWEAFITKLRDDPSQSSELLSEAKKLNDSQAPK | 544 |
| Z12090 | VDAKYAKEADEAAYEIASLPNLTWDQWFAFIEKLRDDPSQSSELLSEAKKLNDSQAPK | 545 |
| Z12091 | VDAKYAKEADDAAYEIANLPNLTWDQWFAFIQKLRDDPSQSSELLSEAKKLNDSQAPK | 546 |
| Z12092 | VDAKYAKEADEAAVEIAALPNLTWDQWYAFIDKLRDDPSQSSELLSEAKKLNDSQAPK | 547 |
| Z12093 | VDAKYAKEADNAAMEIAELPNLTWDQWYAFINKLRDDPSQSSELLSEAKKLNDSQAPK | 548 |
| Z12094 | VDAKYAKEADDAAVEIADLPNLTWDQWYAFINKLRDDPSQSSELLSEAKKLNDSQAPK | 549 |
| Z12095 | VDAKYAKEADEAAYEIAYLPNLTWDQWWAFIQKLRDDPSQSSELLSEAKKLNDSQAPK | 550 |

FIG. 1T

| | | |
|---|---|---|
| Z12096 | VDAKYAKEADDAAFEIALLPNLTWDQWHAFIGKLRDDPSQSSELLSEAKKLNDSQAPK | 551 |
| Z12097 | VDAKYAKEADMAAVEIAGLPNLTWDQWYAFIGKLRDDPSQSSELLSEAKKLNDSQAPK | 552 |
| Z12098 | VDAKYAKEADMAAVEIAELPNLTWDQWWAFIGKLRDDPSQSSELLSEAKKLNDSQAPK | 553 |
| Z12099 | VDAKYAKEADDAAVEIAGLPNLTWDQWFAFIDKLRDDPSQSSELLSEAKKLNDSQAPK | 554 |
| Z12100 | VDAKYAKEADAAAVEIADLPNLTWDQWAFIQKLRDDPSQSSELLSEAKKLNDSQAPK | 555 |
| Z12101 | VDAKYAKEADDAAVEIADLPNLTWDQWYAFIDKLRDDPSQSSELLSEAKKLNDSQAPK | 556 |
| Z12102 | VDAKYAKEADDAAVEIAELPNLTWEQWFAFIGKLRDDPSQSSELLSEAKKLNDSQAPK | 557 |
| Z12103 | VDAKYAKEADDAAVEIAELPNLTWEQWAAFISKLRDDPSQSSELLSEAKKLNDSQAPK | 558 |
| Z12104 | VDAKYAKEADDAAIEIADLPNLTWDQWWAFINKLRDDPSQSSELLSEAKKLNDSQAPK | 559 |
| Z12105 | VDAKYAKEADDAAFEIAMLPNLTWDQWEAFILKLRDDPSQSSELLSEAKKLNDSQAPK | 560 |
| Z12106 | VDAKYAKEADAAMEIADLPNLTWDQWEAFILKLRDDPSQSSELLSEAKKLNDSQAPK | 561 |
| Z12107 | VDAKYAKEADDEAAVEIAELPNLTWDQWAAFIDKLRDDPSQSSELLSEAKKLNDSQAPK | 562 |
| Z12108 | VDAKYAKEADDAAFEIADLPNLTWDQWFAFINKLRDDPSQSSELLSEAKKLNDSQAPK | 563 |
| Z12109 | VDAKYAKEADDAAVEIASLPNLTWDQWFAFILKLRDDPSQSSELLSEAKKLNDSQAPK | 564 |
| Z12110 | VDAKYAKEADDAAVEIADLPNLTWDQWYAFIEKLRDDPSQSSELLSEAKKLNDSQAPK | 565 |
| Z12111 | VDAKYAKEADDAAVEIAALPNLTWDQWMAFIMKLRDDPSQSSELLSEAKKLNDSQAPK | 566 |
| Z12112 | VDAKYAKEADDAAVEIAAVEIAELPNLTWDQWFAFIDKLRDDPSQSSELLSEAKKLNDSQAPK | 567 |
| Z12113 | VDAKYAKEADDAAAYEIAFLPNLTWDQWFAFIEKLRDDPSQSSELLSEAKKLNDSQAPK | 568 |
| Z12114 | VDAKYAKEADRAAFEIAELPNLTWDQWMAFIRKLRDDPSQSSELLSEAKKLNDSQAPK | 569 |
| Z12116 | VDAKYAKEADDAAVEIAELPNLTWDQWFAFIHKLRDDPSQSSELLSEAKKLNDSQAPK | 570 |
| Z12117 | VDAKYAKEADDAAVEIAYLPNLTWDQWFAFITKLRDDPSQSSELLSEAKKLNDSQAPK | 571 |
| Z12118 | VDAKYAKEADDAAMEIADLPNLTWDQMAFISKLRDDPSQSSELLSEAKKLNDSQAPK | 572 |
| Z12119 | VDAKYAKEADDAAVEIAFLPNLTWEQWWAFISKLRDDPSQSSELLSEAKKLNDSQAPK | 573 |
| Z12120 | VDAKYAKEADMAAYEIASLPNLTWDQWFAFISKLRDDPSQSSELLSEAKKLNDSQAPK | 574 |
| Z12121 | VDAKYAKEADDAAFEIANLPNLTWDQWFAFINKLRDDPSQSSELLSEAKKLNDSQAPK | 575 |
| Z12122 | VDAKYAKEADSAAMEIADLPNLTWDQWMAFIQKLRDDPSQSSELLSEAKKLNDSQAPK | 576 |
| Z12123 | VDAKYAKEADDAAVEIASLPNLTWDQWHAFIMKLRDDPSQSSELLSEAKKLNDSQAPK | 577 |
| Z12124 | VDAKYAKEADAAAVEIADLPNLTWDQWHAFITKLRDDPSQSSELLSEAKKLNDSQAPK | 578 |
| Z12125 | VDAKYAKEADDAAVEIANLPNLTWAQWEAFIMKLRDDPSQSSELLSEAKKLNDSQAPK | 579 |

FIG. 1U

| | | |
|---|---|---|
| Z12126 | VDAKYAKEADIAAMEIADLPNLTWDQWWAFINKLRDDPSQSSELLSEAKKLNDSQAPK | 580 |
| Z12127 | VDAKYAKEADHAAVEIAGLPNLTWDQWFAFINKLRDDPSQSSELLSEAKKLNDSQAPK | 581 |
| Z12128 | VDAKYAKEADEAAYEIAELPNLTWDQWWAFIGKLRDDPSQSSELLSEAKKLNDSQAPK | 582 |
| Z12129 | VDAKYAKEADEAAFEIAELPNLTWDQWFAFIGKLRDDPSQSSELLSEAKKLNDSQAPK | 583 |
| Z12130 | VDAKYAKEADAAAVEIANLPNLTWDQWWAFINKLRDDPSQSSELLSEAKKLNDSQAPK | 584 |
| Z12131 | VDAKYAKEADDAAMEIAALPNLTWFQWWAFINKLRDDPSQSSELLSEAKKLNDSQAPK | 585 |
| Z12132 | VDAKYAKEADDAAVEIAELPNLTWDQWFAFIGKLRDDPSQSSELLSEAKKLNDSQAPK | 586 |
| Z12133 | VDAKYAKEADEAAFEIASLPNLTWEQWLAFIAKLRDDPSQSSELLSEAKKLNDSQAPK | 587 |
| Z12134 | VDAKYAKEADDAAIEIAYLPNLTWDQWWAFITKLRDDPSQSSELLSEAKKLNDSQAPK | 588 |
| Z12135 | VDAKYAKEADDAAVEIAFLPNLTWDQWYAFIDKLRDDPSQSSELLSEAKKLNDSQAPK | 589 |
| Z12136 | VDAKYAKEADDAAYEIAQLPNLTWDQWWAAFIQKLRDDPSQSSELLSEAKKLNDSQAPK | 590 |
| Z12137 | VDAKYAKEADDAAVEIALLPNLTWDQWFAFIDKLRDDPSQSSELLSEAKKLNDSQAPK | 591 |
| Z12138 | VDAKYAKEADEAAVEIAYLPNLTWEQWWAFIEKLRDDPSQSSELLSEAKKLNDSQAPK | 592 |
| Z12139 | VDAKYAKEADEAAVEIALLPNLTWDQWFAFITKLRDDPSQSSELLSEAKKLNDSQAPK | 593 |
| Z12140 | VDAKYAKEADDAAAYEIADLPNLTWDQWMAFIEKLRDDPSQSSELLSEAKKLNDSQAPK | 594 |
| Z12141 | VDAKYAKEADDAAYEIAFLPNLTWDQWEAFIDKLRDDPSQSSELLSEAKKLNDSQAPK | 595 |
| Z12142 | VDAKYAKEADAAMEIAELPNLTWDQWAAFIDKLRDDPSQSSELLSEAKKLNDSQAPK | 596 |
| Z12144 | VDAKYAKEADEAAYEIAELPNLTWDQWWAFIQKLRDDPSQSSELLSEAKKLNDSQAPK | 597 |
| Z12145 | VDAKYAKEADDAAYEIAKLPNLTWLQWEAFIAKLRDDPSQSSELLSEAKKLNDSQAPK | 598 |
| Z12146 | VDAKYAKEADEAAYEIAMLPNLTWDQWWAFITKLRDDPSQSSELLSEAKKLNDSQAPK | 599 |
| Z12147 | VDAKYAKEADEAAYEIAELPNLTWDQWWAFIQKLRDDPSQSSELLSEAKKLNDSQAPK | 600 |
| Z12148 | VDAKYAKEADEAAVEIASLPNLTWDQWMQAFITKLRDDPSQSSELLSEAKKLNDSQAPK | 601 |
| Z12149 | VDAKYAKEADDAAYEIAFLPNLTWDQWFAFITKLRDDPSQSSELLSEAKKLNDSQAPK | 602 |
| Z12150 | VDAKYAKEADDAAMEIAELPNLTWDQWWAFIMKLRDDPSQSSELLSEAKKLNDSQAPK | 603 |
| Z12152 | VDAKYAKEADNAAYEIASLPNLTWAQWAAFIEKLRDDPSQSSELLSEAKKLNDSQAPK | 604 |
| Z12153 | VDAKYAKEADMAAFEIASLPNLTWVQWDAFIQKLRDDPSQSSELLSEAKKLNDSQAPK | 605 |
| Z12154 | VDAKYAKEADDAAVEIAYLPNLTWDQWYAFISKLRDDPSQSSELLSEAKKLNDSQAPK | 606 |
| Z12155 | VDAKYAKEADDAAFEIALLPNLTWDQWDAFISKLRDDPSQSSELLSEAKKLNDSQAPK | 607 |
| Z12156 | VDAKYAKEADDAAVEIADLPNLTWDQWWAFIHKLRDDPSQSSELLSEAKKLNDSQAPK | 608 |

FIG. 1V

| | | |
|---|---|---|
| Z12157 | VDAKYAKEADDAAVEIADLPNLTWDQWEAFTAKLRDDPSQSSELLSEAKKLNDSQAPK | 609 |
| Z12158 | VDAKYAKEADMAAIEIADLPNLTWDQWAFITKLRDDPSQSSELLSEAKKLNDSQAPK | 610 |
| Z12159 | VDAKYAKEADDAAVEIADLPNLTWDQWWAFITKLRDDPSQSSELLSEAKKLNDSQAPK | 611 |
| Z12160 | VDAKYAKEADDAAFEIAALPNLTWDQWYAFINKLRDDPSQSSELLSEAKKLNDSQAPK | 612 |
| Z12161 | VDAKYAKEADDAAFEIASLPNLTWDQWYAFINKLRDDPSQSSELLSEAKKLNDSQAPK | 613 |
| Z12162 | VDAKYAKEADAAAEIADLPNLTWDQWAFIHKLRDDPSQSSELLSEAKKLNDSQAPK | 614 |
| Z12164 | VDAKYAKEADDAAYEIAFLPNLTWDQWAFITKLRDDPSQSSELLSEAKKLNDSQAPK | 615 |
| Z12165 | VDAKYAKEADDAAVEIANLPNLTWDQWAFIQKLRDDPSQSSELLSEAKKLNDSQAPK | 616 |
| Z12166 | VDAKYAKEADDAAVEIAALPNLTWDQDAFIRKLRDDPSQSSELLSEAKKLNDSQAPK | 617 |
| Z12167 | VDAKYAKEADDAAVEIAELPNLTWDQWAFIGKLRDDPSQSSELLSEAKKLNDSQAPK | 618 |
| Z12168 | VDAKYAKEADIAAMEIAILPNLTWDQWEAFIWKLRDDPSQSSELLSEAKKLNDSQAPK | 619 |
| Z12169 | VDAKYAKEADSAAVEIADLPNLTWDQWAFITKLRDDPSQSSELLSEAKKLNDSQAPK | 620 |
| Z12170 | VDAKYAKEADEAAVEIANLPNLTWDQWYAFITKLRDDPSQSSELLSEAKKLNDSQAPK | 621 |
| Z12171 | VDAKYAKEADAAAYEIAYLPNLTWDQWAFISKLRDDPSQSSELLSEAKKLNDSQAPK | 622 |
| Z12172 | VDAKYAKEADDAAYEIAALPNLTWDQWYAFITKLRDDPSQSSELLSEAKKLNDSQAPK | 623 |
| Z12173 | VDAKYAKEADIAAVEIAELPNLTWDQWAFIEKLRDDPSQSSELLSEAKKLNDSQAPK | 624 |
| Z12174 | VDAKYAKEADRAAMEIAELPNLTWIQWEAFILKLRDDPSQSSELLSEAKKLNDSQAPK | 625 |
| Z12175 | VDAKYAKEADDAAVEIANLPNLTWDQWEAFILKLRDDPSQSSELLSEAKKLNDSQAPK | 626 |
| Z12176 | VDAKYAKEADEAAMEIAELPNLTWDQWAFIDKLRDDPSQSSELLSEAKKLNDSQAPK | 627 |
| Z12178 | VDAKYAKEADEAAVEIANLPNLTWDQWIAFINKLRDDPSQSSELLSEAKKLNDSQAPK | 628 |
| Z12179 | VDAKYAKEADDAAMEIADLPNLTWDQWIAFIDKLRDDPSQSSELLSEAKKLNDSQAPK | 629 |
| Z12181 | VDAKYAKEADDAAYEIAFLPNLTWDQWYAFINKLRDDPSQSSELLSEAKKLNDSQAPK | 630 |
| Z12182 | VDAKYAKEADDAAVEIADLPNLTWEQWAFINKLRDDPSQSSELLSEAKKLNDSQAPK | 631 |
| Z12183 | VDAKYAKEADDAAYEIAFLPNLTWDQWWAFIEKLRDDPSQSSELLSEAKKLNDSQAPK | 632 |
| Z12184 | VDAKYAKEADEAAVEIAFLPNLTWDQWAFITKLRDDPSQSSELLSEAKKLNDSQAPK | 633 |
| Z12185 | VDAKYAKEADAAAYEIAELPNLTWDQWAFINKLRDDPSQSSELLSEAKKLNDSQAPK | 634 |
| Z12186 | VDAKYAKEADDAAYEIAGLPNLTWDQWAFINKLRDDPSQSSELLSEAKKLNDSQAPK | 635 |
| Z12187 | VDAKYAKEADDAAYEIAFLPNLTWDQDAFIGKLRDDPSQSSELLSEAKKLNDSQAPK | 636 |
| Z12188 | VDAKYAKEADDAAVEIAQLPNLTWDQWFAFINKLRDDPSQSSELLSEAKKLNDSQAPK | 637 |

FIG. 1W

| | | |
|---|---|---|
| Z12189 | VDAKYAKEADQAAYEIAFLPNLTWDQWEAFIFKLRDDPSQSSELLSEAKKLNDSQAPK | 638 |
| Z12190 | VDAKYAKEADSAAVEIADLPNLTWAQWDAFISKLRDDPSQSSELLSEAKKLNDSQAPK | 639 |
| Z12191 | VDAKYAKEADAAAMEIANLPNLTWDQWEAFIQKLRDDPSQSSELLSEAKKLNDSQAPK | 640 |
| Z12193 | VDAKYAKEADGAALEIAELPNLTWDQWEAFIQKLRDDPSQSSELLSEAKKLNDSQAPK | 641 |
| Z12194 | VDAKYAKEADEAAVEIADLPNLTWDQWNYAFISKLRDDPSQSSELLSEAKKLNDSQAPK | 642 |
| Z12195 | VDAKYAKEADDAAYEIAELPNLTWDQWFAFIHKLRDDPSQSSELLSEAKKLNDSQAPK | 643 |
| Z12196 | VDAKYAKEADDAAFEIAALPNLTWEQWMAFIEKLRDDPSQSSELLSEAKKLNDSQAPK | 644 |
| Z12197 | VDAKYAKEADDAAYEIAYLPNLTWDQWYAFIGKLRDDPSQSSELLSEAKKLNDSQAPK | 645 |
| Z12198 | VDAKYAKEADQAAMEIADLPNLTWDQWAAFIMKLRDDPSQSSELLSEAKKLNDSQAPK | 646 |
| Z12199 | VDAKYAKEADDAAYEIAYLPNLTWDQWWAFINKLRDDPSQSSELLSEAKKLNDSQAPK | 647 |
| Z12200 | VDAKYAKEADDAAMEIASLPNLTWDQWFAFIAKLRDDPSQSSELLSEAKKLNDSQAPK | 648 |
| Z12201 | VDAKYAKEADEAAVEIADLPNLTWEQWAAFINKLRDDPSQSSELLSEAKKLNDSQAPK | 649 |
| Z12202 | VDAKYAKEADDAAVEIADLPNLTWDQWWAFINKLRDDPSQSSELLSEAKKLNDSQAPK | 650 |
| Z12203 | VDAKYAKEADAAAVEIAELPNLTWDQWDAFITKLRDDPSQSSELLSEAKKLNDSQAPK | 651 |
| Z12204 | VDAKYAKEADNAAMEIADLPNLTWDQWMAFIEKLRDDPSQSSELLSEAKKLNDSQAPK | 652 |
| Z12205 | VDAKYAKEADHAAMEIAELPNLTWDQWWAFIDKLRDDPSQSSELLSEAKKLNDSQAPK | 653 |
| Z12206 | VDAKYAKEADAAAYEIAALPNLTWDQWAFITKLRDDPSQSSELLSEAKKLNDSQAPK | 654 |
| Z12207 | VDAKYAKEADEAAFEIALLPNLTWDQWLAFIDKLRDDPSQSSELLSEAKKLNDSQAPK | 655 |
| Z12208 | VDAKYAKEADDAALEIADLPNLTWDQWNFAFIDKLRDDPSQSSELLSEAKKLNDSQAPK | 656 |
| Z12209 | VDAKYAKEADKAAMEIADLPNLTWDQWEAFILKLRDDPSQSSELLSEAKKLNDSQAPK | 657 |
| Z12210 | VDAKYAKEADAAAMEIADLPNLTWDQWWAFITKLRDDPSQSSELLSEAKKLNDSQAPK | 658 |
| Z12213 | VDAKYAKEADNAAVEIAELPNLTWDQWFAFIGKLRDDPSQSSELLSEAKKLNDSQAPK | 659 |
| Z12214 | VDAKYAKEADDAAIEIAEAAIEIAELPNLTWDQWAAFIWKLRDDPSQSSELLSEAKKLNDSQAPK | 660 |
| Z12215 | VDAKYAKEADQAAYEIAELPNLTWDQWFAFIGKLRDDPSQSSELLSEAKKLNDSQAPK | 661 |
| Z12216 | VDAKYAKEADDAAIEIAELPNLTWDQWMAFIDKLRDDPSQSSELLSEAKKLNDSQAPK | 662 |
| Z12217 | VDAKYAKEADDAAYEIAMLPNLTWEQWMAFITKLRDDPSQSSELLSEAKKLNDSQAPK | 663 |
| Z12218 | VDAKYAKEADTAAYEIAGLPNLTWDQWMAFINKLRDDPSQSSELLSEAKKLNDSQAPK | 664 |
| Z12219 | VDAKYAKEADNAAYEIAGLPNLTWDQWYAFIGKLRDDPSQSSELLSEAKKLNDSQAPK | 665 |
| Z12220 | VDAKYAKEADEAAVEIADLPNLTWAQWWAFIEKLRDDPSQSSELLSEAKKLNDSQAPK | 666 |

FIG. 1X

| ID | Sequence | # |
|---|---|---|
| Z12221 | VDAKYAKEADDAAVEIAYLPNLTWDQWYAFITKLRDDPSQSSELLSEAKKLNDSQAPK | 667 |
| Z12222 | VDAKYAKEADKAAVEIAYLPNLTWDQWWAFIGKLRDDPSQSSELLSEAKKLNDSQAPK | 668 |
| Z12223 | VDAKYAKEADDAAYEIADLPNLTWDQWMAFIDKLRDDPSQSSELLSEAKKLNDSQAPK | 669 |
| Z12224 | VDAKYAKEADDAAVEIADLPNLTWDQWFAFIDKLRDDPSQSSELLSEAKKLNDSQAPK | 670 |
| Z12225 | VDAKYAKEADDAAVEIADLPNLTWDQWAAFIEKLRDDPSQSSELLSEAKKLNDSQAPK | 671 |
| Z12226 | VDAKYAKEADTAAMEIADLPNLTWDQWLAFITKLRDDPSQSSELLSEAKKLNDSQAPK | 672 |
| Z12227 | VDAKYAKEADAAAVEIADLPNLTWDQWYAFIGKLRDDPSQSSELLSEAKKLNDSQAPK | 673 |
| Z12228 | VDAKYAKEADDAAVEIAELPNLTWDQWFAFIDKLRDDPSQSSELLSEAKKLNDSQAPK | 674 |
| Z12229 | VDAKYAKEADDAAVEIAALPNLTWDQWEAFIHKLRDDPSQSSELLSEAKKLNDSQAPK | 675 |
| Z12230 | VDAKYAKEADDAAYEIAYLPNLTWDQWFAFIEKLRDDPSQSSELLSEAKKLNDSQAPK | 676 |
| Z12231 | VDAKYAKEADQAAYEIADLPNLTWDQWYAFISKLRDDPSQSSELLSEAKKLNDSQAPK | 677 |
| Z12232 | VDAKYAKEADEAAYEIAELPNLTWDQWAAFIHKLRDDPSQSSELLSEAKKLNDSQAPK | 678 |
| Z12233 | VDAKYAKEADDAAYEIAFLPNLTWDQWHAFIDKLRDDPSQSSELLSEAKKLNDSQAPK | 679 |
| Z12234 | VDAKYAKEADKAAVEIADLPNLTWDQWFAFIGKLRDDPSQSSELLSEAKKLNDSQAPK | 680 |
| Z12235 | VDAKYAKEADDAAVEIAELPNLTWDQWWAFIQKLRDDPSQSSELLSEAKKLNDSQAPK | 681 |
| Z12236 | VDAKYAKEADEAAVEIAELPNLTWDQWWAFIQKLRDDPSQSSELLSEAKKLNDSQAPK | 682 |
| Z12237 | VDAKYAKEADDAAYEIAELPNLTWDQWFAFIQKLRDDPSQSSELLSEAKKLNDSQAPK | 683 |
| Z12238 | VDAKYAKEADDAAMEIAGLPNLTWDQWAAFIDKLRDDPSQSSELLSEAKKLNDSQAPK | 684 |
| Z12239 | VDAKYAKEADSAAVEIADLPNLTWDQWYAFIQKLRDDPSQSSELLSEAKKLNDSQAPK | 685 |
| Z12240 | VDAKYAKEADEAAVEIAELPNLTWDQWFAFISKLRDDPSQSSELLSEAKKLNDSQAPK | 686 |
| Z12241 | VDAKYAKEADAAMEIADLPNLTWDQWMAFIQKLRDDPSQSSELLSEAKKLNDSQAPK | 687 |
| Z12242 | VDAKYAKEADDAAVEIALLPNLTWDQWYAFIQKLRDDPSQSSELLSEAKKLNDSQAPK | 688 |
| Z12243 | VDAKYAKEADEAAVEIAELPNLTWEQWFAFIEKLRDDPSQSSELLSEAKKLNDSQAPK | 689 |
| Z12244 | VDAKYAKEADDAAVEIADLPNLTWDQWFAFIKKLRDDPSQSSELLSEAKKLNDSQAPK | 690 |
| Z12245 | VDAKYAKEADDAAVEIAYLPNLTWDQWAFIGKLRDDPSQSSELLSEAKKLNDSQAPK | 691 |
| Z12246 | VDAKYAKEADQAAVEIAELPNLTWDQWAAFIDKLRDDPSQSSELLSEAKKLNDSQAPK | 692 |
| Z12247 | VDAKYAKEADAAMEIADLPNLTWDQWYAFIEKLRDDPSQSSELLSEAKKLNDSQAPK | 693 |
| Z12248 | VDAKYAKEADDAAFEIALLPNLTWVQWEAFIEKLRDDPSQSSELLSEAKKLNDSQAPK | 694 |
| Z12249 | VDAKYAKEADDAAYEIAQLPNLTWDQWYAFIDKLRDDPSQSSELLSEAKKLNDSQAPK | 695 |

FIG. 1Y

| ID | Sequence | # |
|---|---|---|
| Z12250 | VDAKYAKEADMAAVEIADLPNLTWDQWHAFISKLRDDPSQSSELLSEAKKLNDSQAPK | 696 |
| Z12251 | VDAKYAKEADDAAFEIAQLPNLTWDQWFAFINKLRDDPSQSSELLSEAKKLNDSQAPK | 697 |
| Z12252 | VDAKYAKEADDAAVEIAELPNLTWDQWYAFISKLRDDPSQSSELLSEAKKLNDSQAPK | 698 |
| Z12253 | VDAKYAKEADDAAYEIAYLPNLTWAQWYAFISKLRDDPSQSSELLSEAKKLNDSQAPK | 699 |
| Z12254 | VDAKYAKEADAAMEIANLPNLTWDQWYAFINKLRDDPSQSSELLSEAKKLNDSQAPK | 700 |
| Z12257 | VDAKYAKEADEAAYEIAMLPNLTWDQWDAFIGKLRDDPSQSSELLSEAKKLNDSQAPK | 701 |
| Z12258 | VDAKYAKEADEAAFEIAQLPNLTWDQWFAFIDKLRDDPSQSSELLSEAKKLNDSQAPK | 702 |
| Z12259 | VDAKYAKEADDAAVEIAELPNLTWDQWYAFINKLRDDPSQSSELLSEAKKLNDSQAPK | 703 |
| Z12260 | VDAKYAKEADNAAFEIAGLPNLTWDQWDAFIQKLRDDPSQSSELLSEAKKLNDSQAPK | 704 |
| Z12261 | VDAKYAKEADMAAVEIAALPNLTWDQWYAFINKLRDDPSQSSELLSEAKKLNDSQAPK | 705 |
| Z12262 | VDAKYAKEADDAAFEIAFLPNLTWDQWFAFIQKLRDDPSQSSELLSEAKKLNDSQAPK | 706 |
| Z12263 | VDAKYAKEADKAAVEIADLPNLTWDQWWAFINKLRDDPSQSSELLSEAKKLNDSQAPK | 707 |
| Z12265 | VDAKYAKEADSAAVEIADLPNLTWDQWWAFIEKLRDDPSQSSELLSEAKKLNDSQAPK | 708 |
| Z12266 | VDAKYAKEADAAMEIAALPNLTWDQWFAFIQKLRDDPSQSSELLSEAKKLNDSQAPK | 709 |
| Z12267 | VDAKYAKEADDAAFEIAQLPNLTWDQWFAFINKLRDDPSQSSELLSEAKKLNDSQAPK | 710 |
| Z12268 | VDAKYAKEADQAAVEIASLPNLTWEQWYAFIAKLRDDPSQSSELLSEAKKLNDSQAPK | 711 |
| Z12269 | VDAKYAKEADEAAYEIAELPNLTWDQWFAFIQKLRDDPSQSSELLSEAKKLNDSQAPK | 712 |
| Z12270 | VDAKYAKEADMAAVEIADLPNLTWDQWYAFIEKLRDDPSQSSELLSEAKKLNDSQAPK | 713 |
| Z12271 | VDAKYAKEADDAAVEIADLPNLTWWQWFAFIEKLRDDPSQSSELLSEAKKLNDSQAPK | 714 |
| Z12272 | VDAKYAKEADDAAYEIAGLPNLTWDQWFAFIDKLRDDPSQSSELLSEAKKLNDSQAPK | 715 |
| Z12273 | VDAKYAKEADEAAVEIADLPNLTWEQWWAFIEKLRDDPSQSSELLSEAKKLNDSQAPK | 716 |
| Z12274 | VDAKYAKEADMAAVEIADLPNLTWDQWAFITKLRDDPSQSSELLSEAKKLNDSQAPK | 717 |
| Z12276 | VDAKYAKEADDAAVEIAELPNLTWDQWMAFIQKLRDDPSQSSELLSEAKKLNDSQAPK | 718 |
| Z12277 | VDAKYAKEADQAAVEIAFLPNLTWDQWYAFIHKLRDDPSQSSELLSEAKKLNDSQAPK | 719 |
| Z12278 | VDAKYAKEADKAAVEIAELPNLTWDQWEAFIAKLRDDPSQSSELLSEAKKLNDSQAPK | 720 |
| Z12279 | VDAKYAKEADNAAVEIAELPNLTWDQWYAFIEKLRDDPSQSSELLSEAKKLNDSQAPK | 721 |
| Z12280 | VDAKYAKEADDAAVEIAELPNLTWDQWYAFIQKLRDDPSQSSELLSEAKKLNDSQAPK | 722 |
| Z12281 | VDAKYAKEADDAAMEIANLPNLTWDQWEAFIQKLRDDPSQSSELLSEAKKLNDSQAPK | 723 |
| Z12282 | VDAKYAKEADMAAVEIASLPNLTWDQWYAFINKLRDDPSQSSELLSEAKKLNDSQAPK | 724 |

FIG. 1Z

| | | |
|---|---|---|
| Z12284 | VDAKYAKEADDAAYEIAFLPNLTWDQWWAFISKLRDDPSQSSELLSEAKKLNDSQAPK | 725 |
| Z12286 | VDAKYAKEADDAAIEIAELPNLTWDQWWAFINKLRDDPSQSSELLSEAKKLNDSQAPK | 726 |
| Z12287 | VDAKYAKEADDAAMEIADLPNLTWDQWWAFINKLRDDPSQSSELLSEAKKLNDSQAPK | 727 |
| Z12288 | VDAKYAKEADDAAVEIAMLPNLTWDQWFAFIGKLRDDPSQSSELLSEAKKLNDSQAPK | 728 |
| Z12290 | VDAKYAKEADDAAYEIAYLPNLTWDQWFAFINKLRDDPSQSSELLSEAKKLNDSQAPK | 729 |
| Z12291 | VDAKYAKEADDAAVEIADLPNLTWDQWWAFISKLRDDPSQSSELLSEAKKLNDSQAPK | 730 |
| Z12292 | VDAKYAKEADDAAVEIAQLPNLTWDQWFAFIYKLRDDPSQSSELLSEAKKLNDSQAPK | 731 |
| Z12293 | VDAKYAKEADNAAVEIADLPNLTWDQWYAFIWKLRDDPSQSSELLSEAKKLNDSQAPK | 732 |
| Z12294 | VDAKYAKEADEAAVEIAALPNLTWDQWEAFINKLRDDPSQSSELLSEAKKLNDSQAPK | 733 |
| Z12295 | VDAKYAKEADGAAVEIANLPNLTWDQWFAFINKLRDDPSQSSELLSEAKKLNDSQAPK | 734 |
| Z12296 | VDAKYAKEADDAAFEIAELPNLTWDQWFAFIDKLRDDPSQSSELLSEAKKLNDSQAPK | 735 |
| Z12297 | VDAKYAKEADDAAVEIAQLPNLTWDQWFAFIQKLRDDPSQSSELLSEAKKLNDSQAPK | 736 |
| Z12298 | VDAKYAKEADDAAMEIALLPNLTWDQWLAFIQKLRDDPSQSSELLSEAKKLNDSQAPK | 737 |
| Z12299 | VDAKYAKEADDAAVEIADLPNLTWDQWEAFIQKLRDDPSQSSELLSEAKKLNDSQAPK | 738 |
| Z12300 | VDAKYAKEADDAAVEIADLPNLTWEQWWAFIEKLRDDPSQSSELLSEAKKLNDSQAPK | 739 |
| Z12301 | VDAKYAKEADDAAVEIAMLPNLTWDQWDAFITKLRDDPSQSSELLSEAKKLNDSQAPK | 740 |
| Z12302 | VDAKYAKEADLAAVEIAELPNLTWAQWFAFIMKLRDDPSQSSELLSEAKKLNDSQAPK | 741 |
| Z12303 | VDAKYAKEADDAAYEIASLPNLTWDQWYAFIHKLRDDPSQSSELLSEAKKLNDSQAPK | 742 |
| Z12304 | VDAKYAKEADQAAMEIAELPNLTWDQWEAFITKLRDDPSQSSELLSEAKKLNDSQAPK | 743 |
| Z12305 | VDAKYAKEADEAAYLAAVEIAELPNLTWDQWFAFIMKLRDDPSQSSELLSEAKKLNDSQAPK | 744 |
| Z12306 | VDAKYAKEADMAAVEIASLPNLTWDQWYAFINKLRDDPSQSSELLSEAKKLNDSQAPK | 745 |
| Z12307 | VDAKYAKEADNAAVEIADLPNLTWDQWAFIEKLRDDPSQSSELLSEAKKLNDSQAPK | 746 |
| Z12308 | VDAKYAKEADDAAYEIASLPNLTWDQWAFIEKLRDDPSQSSELLSEAKKLNDSQAPK | 747 |
| Z12309 | VDAKYAKEADDAAVEIADLPNLTWDQWYAFISKLRDDPSQSSELLSEAKKLNDSQAPK | 748 |
| Z12310 | VDAKYAKEADDAAVEIADLPNLTWDQWDAFIMKLRDDPSQSSELLSEAKKLNDSQAPK | 749 |
| Z12311 | VDAKYAKEADDAAVEIADLPNLTWDQWAFIEKLRDDPSQSSELLSEAKKLNDSQAPK | 750 |
| Z12312 | VDAKYAKEADMAAVEIADLPNLTWDQWAFIEKLRDDPSQSSELLSEAKKLNDSQAPK | 751 |
| Z12313 | VDAKYAKEADEAAYEIAFLPNLTWDQWFAFIEKLRDDPSQSSELLSEAKKLNDSQAPK | 752 |
| Z12314 | VDAKYAKEADIAAVEIADLPNLTWDQWWAFIEKLRDDPSQSSELLSEAKKLNDSQAPK | 753 |

FIG. 1AA

| ID | Sequence | # |
|---|---|---|
| Z12315 | VDAKYAKEADDAAIEIAELPNLTWDQWYAFIEKLRDDPSQSSELLSEAKKLNDSQAPK | 754 |
| Z12316 | VDAKYAKEADIAAMEIADLPNLTWDQWWAFIGKLRDDPSQSSELLSEAKKLNDSQAPK | 755 |
| Z12317 | VDAKYAKEADNAAMEIADLPNLTWDQWYAFIDKLRDDPSQSSELLSEAKKLNDSQAPK | 756 |
| Z12318 | VDAKYAKEADDAAYEIADLPNLTWLQWYAFIEKLRDDPSQSSELLSEAKKLNDSQAPK | 757 |
| Z12319 | VDAKYAKEADEAAVEIASLPNLTWDQWWAFIEKLRDDPSQSSELLSEAKKLNDSQAPK | 758 |
| Z12320 | VDAKYAKEADAAAVEIADLPNLTWQQWEAFIDKLRDDPSQSSELLSEAKKLNDSQAPK | 759 |
| Z12321 | VDAKYAKEADMAAVEIAELPNLTWDQWYAFIDKLRDDPSQSSELLSEAKKLNDSQAPK | 760 |
| Z12322 | VDAKYAKEADAAMEIADLPNLTWDQWAFIEKLRDDPSQSSELLSEAKKLNDSQAPK | 761 |
| Z12323 | VDAKYAKEADDAAFEIAQLPNLTWDQWFAFITKLRDDPSQSSELLSEAKKLNDSQAPK | 762 |
| Z12324 | VDAKYAKEADDAAFEIASLPNLTWDQWWAFIEKLRDDPSQSSELLSEAKKLNDSQAPK | 763 |
| Z12325 | VDAKYAKEADDAAVEIAILPNLTWDQWFAFIAKLRDDPSQSSELLSEAKKLNDSQAPK | 764 |
| Z12326 | VDAKYAKEADLAAVEIAELPNLTWDQWEAFILKLRDDPSQSSELLSEAKKLNDSQAPK | 765 |
| Z12327 | VDAKYAKEADLAAVEIADLPNLTWEQWFAFIQKLRDDPSQSSELLSEAKKLNDSQAPK | 766 |
| Z12328 | VDAKYAKEADSAAYEIAFLPNLTWDQWYAFIQKLRDDPSQSSELLSEAKKLNDSQAPK | 767 |
| Z12329 | VDAKYAKEADDAAMEIADLPNLTWDQWFAFIEKLRDDPSQSSELLSEAKKLNDSQAPK | 768 |
| Z12330 | VDAKYAKEADNAAVEIADLPNLTWDQWFAFIQKLRDDPSQSSELLSEAKKLNDSQAPK | 769 |
| Z12331 | VDAKYAKEADDAAFEIAMLPNLTWDQWFAFIDKLRDDPSQSSELLSEAKKLNDSQAPK | 770 |
| Z12332 | VDAKYAKEADEAAVEIADLPNLTWEQWWAFIEKLRDDPSQSSELLSEAKKLNDSQAPK | 771 |
| Z12333 | VDAKYAKEADSAAYEIAFLPNLTWDQWFAFISKLRDDPSQSSELLSEAKKLNDSQAPK | 772 |
| Z12334 | VDAKYAKEADDAAMEIAFLPNLTWDQWFAFIEKLRDDPSQSSELLSEAKKLNDSQAPK | 773 |
| Z12335 | VDAKYAKEADDAAYEIAFLPNLTWEQWHAFIEKLRDDPSQSSELLSEAKKLNDSQAPK | 774 |
| Z12336 | VDAKYAKEADLAALEIAELPNLTWDQWFAFINKLRDDPSQSSELLSEAKKLNDSQAPK | 775 |
| Z12337 | VDAKYAKEADLAAYEIAFLPNLTWDQWFAFISKLRDDPSQSSELLSEAKKLNDSQAPK | 776 |
| Z12338 | VDAKYAKEADDAAIEIAELPNLTWDQWFAFIDKLRDDPSQSSELLSEAKKLNDSQAPK | 777 |
| Z12339 | VDAKYAKEADDAAMEIAELPNLTWEQWWAFIDKLRDDPSQSSELLSEAKKLNDSQAPK | 778 |
| Z12340 | VDAKYAKEADMAAMEIAELPNLTWDQWFAFIMKLRDDPSQSSELLSEAKKLNDSQAPK | 779 |
| Z12341 | VDAKYAKEADLAAVEIADLPNLTWDQWEAFILKLRDDPSQSSELLSEAKKLNDSQAPK | 780 |
| Z12342 | VDAKYAKEADVEIADLPNLTWDQWWAFILKLRDDPSQSSELLSEAKKLNDSQAPK | 781 |
| Z12343 | VDAKYAKEADDAAMEIADLPNLTWDQWWAFIGKLRDDPSQSSELLSEAKKLNDSQAPK | 782 |

FIG. 1BB

| ID | Sequence | # |
|---|---|---|
| Z12345 | VDAKYAKEADRAAMEIADLPNLTWDQMDAFITKLRDDPSQSSELLSEAKKLNDSQAPK | 783 |
| Z12346 | VDAKYAKEADDAAYEIAFLPNLTWDQWWAFIEKLRDDPSQSSELLSEAKKLNDSQAPK | 784 |
| Z12347 | VDAKYAKEADMAAVEIADLPNLTWDQWWAFIQKLRDDPSQSSELLSEAKKLNDSQAPK | 785 |
| Z12348 | VDAKYAKEADDAAVEIANLPNLTWDQWWAFIGKLRDDPSQSSELLSEAKKLNDSQAPK | 786 |
| Z12350 | VDAKYAKEADDAAFEIALLPNLTWDQWHAFILKLRDDPSQSSELLSEAKKLNDSQAPK | 787 |
| Z12351 | VDAKYAKEADDAAVEIAELPNLTWVQWWAFIEKLRDDPSQSSELLSEAKKLNDSQAPK | 788 |
| Z12352 | VDAKYAKEADEAALEIADLPNLTWDQWWAFIEKLRDDPSQSSELLSEAKKLNDSQAPK | 789 |
| Z12353 | VDAKYAKEADDAAVEIADLPNLTWDQWWAFIDKLRDDPSQSSELLSEAKKLNDSQAPK | 790 |
| Z12354 | VDAKYAKEADDAAAEIADLPNLTWDQWYAFIDKLRDDPSQSSELLSEAKKLNDSQAPK | 791 |
| Z12355 | VDAKYAKEADEAAYEIAAYEIADLPNLTWDQWWAFITKLRDDPSQSSELLSEAKKLNDSQAPK | 792 |
| Z12356 | VDAKYAKEADDAAVEIAFLPNLTWDQWWAFIEKLRDDPSQSSELLSEAKKLNDSQAPK | 793 |
| Z12357 | VDAKYAKEADDAAAYEIAFLPNLTWAQWWAFIQKLRDDPSQSSELLSEAKKLNDSQAPK | 794 |
| Z12358 | VDAKYAKEADDAAAYEIAFLPNLTWDQWWAFIGKLRDDPSQSSELLSEAKKLNDSQAPK | 795 |
| Z12360 | VDAKYAKEADDAAAAYEIADLPNLTWEQWWAFITKLRDDPSQSSELLSEAKKLNDSQAPK | 796 |
| Z12361 | VDAKYAKEADDAAAYEIAALPNLTWDQWWAFIRKLRDDPSQSSELLSEAKKLNDSQAPK | 797 |
| Z12362 | VDAKYAKEADDAAAYEIADLPNLTWDQWYAFIDKLRDDPSQSSELLSEAKKLNDSQAPK | 798 |
| Z12363 | VDAKYAKEADNAAFEIAELPNLTWDQWWAFIEKLRDDPSQSSELLSEAKKLNDSQAPK | 799 |
| Z12364 | VDAKYAKEADQAAMEIADLPNLTWDQWWAFIDKLRDDPSQSSELLSEAKKLNDSQAPK | 800 |
| Z12365 | VDAKYAKEADQAAMEIAELPNLTWDQWWAFIQKLRDDPSQSSELLSEAKKLNDSQAPK | 801 |
| Z12366 | VDAKYAKEADEAAFEIAELPNLTWEQWFAFINKLRDDPSQSSELLSEAKKLNDSQAPK | 802 |
| Z12367 | VDAKYAKEADDAAVEIAFLPNLTWDQWFAFIAKLRDDPSQSSELLSEAKKLNDSQAPK | 803 |
| Z12368 | VDAKYAKEADDAAVEIAALPNLTWDQWEAFIAKLRDDPSQSSELLSEAKKLNDSQAPK | 804 |
| Z12369 | VDAKYAKEADMAAIEIADLPNLTWDQWYAFITKLRDDPSQSSELLSEAKKLNDSQAPK | 805 |
| Z12370 | VDAKYAKEADDAAVEIANLPNLTWDQWWAFITKLRDDPSQSSELLSEAKKLNDSQAPK | 806 |
| Z12371 | VDAKYAKEADQAAMEIAYLPNLTWDQWYAFIEKLRDDPSQSSELLSEAKKLNDSQAPK | 807 |
| Z12372 | VDAKYAKEADKAAVEIAELPNLTWDQWWAFIDKLRDDPSQSSELLSEAKKLNDSQAPK | 808 |
| Z12373 | VDAKYAKEADEAAVEIASLPNLTWDQWYAFIWKLRDDPSQSSELLSEAKKLNDSQAPK | 809 |
| Z12374 | VDAKYAKEADMAAVEIADLPNLTWDQWWAFINKLRDDPSQSSELLSEAKKLNDSQAPK | 810 |
| Z12375 | VDAKYAKEADAAAMEIAMLPNLTWDQMDAFISKLRDDPSQSSELLSEAKKLNDSQAPK | 811 |

FIG. 1CC

| | | |
|---|---|---|
| Z12376 | VDAKYAKEADDAAYEIAFLPNLTWDQWDAFIQKLRDDPSQSSELLSEAKKLNDSQAPK | 812 |
| Z12377 | VDAKYAKEADNAAYEIADLPNLTWDQWFAFIHKLRDDPSQSSELLSEAKKLNDSQAPK | 813 |
| Z12378 | VDAKYAKEADDAAVEIAGLPNLTWDQWFAFIGKLRDDPSQSSELLSEAKKLNDSQAPK | 814 |
| Z12379 | VDAKYAKEADDAAVEIAGLPNLTWDQWDAFILKLRDDPSQSSELLSEAKKLNDSQAPK | 815 |
| Z12380 | VDAKYAKEADNAAMEIAELPNLTWDQWDAFIDKLRDDPSQSSELLSEAKKLNDSQAPK | 816 |
| Z12381 | VDAKYAKEADMAAMEIASLPNLTWDQWFAFIDKLRDDPSQSSELLSEAKKLNDSQAPK | 817 |
| Z12382 | VDAKYAKEADHAAVEIAALPNLTWDQWDAFIRKLRDDPSQSSELLSEAKKLNDSQAPK | 818 |
| Z12383 | VDAKYAKEADEAAMEIADLPNLTWDQWYAFINKLRDDPSQSSELLSEAKKLNDSQAPK | 819 |
| Z12384 | VDAKYAKEADNAAVEIADLPNLTWDQWFAFIEKLRDDPSQSSELLSEAKKLNDSQAPK | 820 |
| Z12385 | VDAKYAKEADDAAVEIALLPNLTWDQWDAFIAKLRDDPSQSSELLSEAKKLNDSQAPK | 821 |
| Z12386 | VDAKYAKEADDAAVEIAYLPNLTWDQWYAFIRKLRDDPSQSSELLSEAKKLNDSQAPK | 822 |
| Z12387 | VDAKYAKEADKAAVEIAYLPNLTWDQWYAFIHKLRDDPSQSSELLSEAKKLNDSQAPK | 823 |
| Z12388 | VDAKYAKEADNAAFEIAELPNLTWDQWYAFIHKLRDDPSQSSELLSEAKKLNDSQAPK | 824 |
| Z12389 | VDAKYAKEADAAAYEIAFLPNLTWDQWAAFIHKLRDDPSQSSELLSEAKKLNDSQAPK | 825 |
| Z12390 | VDAKYAKEADQAAVEIADLPNLTWDQWWAFIQKLRDDPSQSSELLSEAKKLNDSQAPK | 826 |
| Z12391 | VDAKYAKEADDAAVEIAALPNLTWDQWNAFIQKLRDDPSQSSELLSEAKKLNDSQAPK | 827 |
| Z12392 | VDAKYAKEADEAAYEIADLPNLTWDQWFAFIHKLRDDPSQSSELLSEAKKLNDSQAPK | 828 |
| Z12393 | VDAKYAKEADFAAVEIASLPNLFWDQWAAFIQKLRDDPSQSSELLSEAKKLNDSQAPK | 829 |
| Z12394 | VDAKYAKEADEAAVEIAELPNLTWDQWFAFIDKLRDDPSQSSELLSEAKKLNDSQAPK | 830 |
| Z12395 | VDAKYAKEADMAAYEIAELPNLTWDQWQAFITKLRDDPSQSSELLSEAKKLNDSQAPK | 831 |
| Z12396 | VDAKYAKEADDAAMEIADLPNLTWDQWFAFIHKLRDDPSQSSELLSEAKKLNDSQAPK | 832 |
| Z12397 | VDAKYAKEADDAAVEIAALPNLTWDQWFAFIGKLRDDPSQSSELLSEAKKLNDSQAPK | 833 |
| Z12398 | VDAKYAKEADSAAYEIAFLPNLTWDQWYAFITKLRDDPSQSSELLSEAKKLNDSQAPK | 834 |
| Z12399 | VDAKYAKEADAAAYEIAFIWDQWYAFIWKLRDDPSQSSELLSEAKKLNDSQAPK | 835 |
| Z12400 | VDAKYAKEADQAAFEIAELPNLTWDQWYAFITKLRDDPSQSSELLSEAKKLNDSQAPK | 836 |
| Z12401 | VDAKYAKEADEAAVEIANLPNLTWDQWEAFIRKLRDDPSQSSELLSEAKKLNDSQAPK | 837 |
| Z12402 | VDAKYAKEADMAAYEIAGLPNLTWDQWYAFIDKLRDDPSQSSELLSEAKKLNDSQAPK | 838 |
| Z12403 | VDAKYAKEADAAAFEIAAMEIADLPNLTWDQWWAFINKLRDDPSQSSELLSEAKKLNDSQAPK | 839 |
| Z12404 | VDAKYAKEADIAAMEIADLPNLTWDQWFAFINKLRDDPSQSSELLSEAKKLNDSQAPK | 840 |

FIG. 1DD

| | | |
|---|---|---|
| Z12405 | VDAKYAKEADEAAVEIAELPNLTWDQWFAFISKLRDDPSQSSELLSEAKKLNDSQAPK | 841 |
| Z12406 | VDAKYAKEADLAAVEIADLPNLTWDQWWAFISKLRDDPSQSSELLSEAKKLNDSQAPK | 842 |
| Z12407 | VDAKYAKEADDAAFEIASLPNLTWDQWLAFIGKLRDDPSQSSELLSEAKKLNDSQAPK | 843 |
| Z12408 | VDAKYAKEADMAAVEIADLPNLTWDQWFAFIGKLRDDPSQSSELLSEAKKLNDSQAPK | 844 |
| Z12409 | VDAKYAKEADDAAVEIAYLPNLTWDQWYAFIRKLRDDPSQSSELLSEAKKLNDSQAPK | 845 |
| Z12410 | VDAKYAKEADRAAYEIAELPNLTWDQWDAFINKLRDDPSQSSELLSEAKKLNDSQAPK | 846 |
| Z12411 | VDAKYAKEADEAAVEIAGLPNLTWDQWFAFINKLRDDPSQSSELLSEAKKLNDSQAPK | 847 |
| Z12412 | VDAKYAKEADHAAMEIADLPNLTWEQWAAFIDKLRDDPSQSSELLSEAKKLNDSQAPK | 848 |
| Z12413 | VDAKYAKEADIAALEIAGLPNLTWDQWFAFIDKLRDDPSQSSELLSEAKKLNDSQAPK | 849 |
| Z12414 | VDAKYAKEADEAAYEIAFLPNLTWDQWFAFIGKLRDDPSQSSELLSEAKKLNDSQAPK | 850 |
| Z12415 | VDAKYAKEADRAAVEIAALPNLTWDQWFAFINKLRDDPSQSSELLSEAKKLNDSQAPK | 851 |
| Z12416 | VDAKYAKEADEAAVEIADLPNLTWDQWFAFINKLRDDPSQSSELLSEAKKLNDSQAPK | 852 |
| Z12417 | VDAKYAKEADDAAMEIADLPNLTWDQWAAFIGKLRDDPSQSSELLSEAKKLNDSQAPK | 853 |
| Z12418 | VDAKYAKEADEAAYEIALLPNLTWDQWFAFIMKLRDDPSQSSELLSEAKKLNDSQAPK | 854 |
| Z12419 | VDAKYAKEADSAAVEIASLPNLTWDQWLAFINKLRDDPSQSSELLSEAKKLNDSQAPK | 855 |
| Z12420 | VDAKYAKEADEAAYEIAYLPNLTWDQWYAFINKLRDDPSQSSELLSEAKKLNDSQAPK | 856 |
| Z12421 | VDAKYAKEADMAAYEIAELPNLTWDQWFAFINKLRDDPSQSSELLSEAKKLNDSQAPK | 857 |
| Z12422 | VDAKYAKEADAAAMEIADLPNLTWDQWWAFIMKLRDDPSQSSELLSEAKKLNDSQAPK | 858 |
| Z12423 | VDAKYAKEADDAAYEIAFLPNLTWDQWLAFIEKLRDDPSQSSELLSEAKKLNDSQAPK | 859 |
| Z12424 | VDAKYAKEADAAVEIADLPNLTWDQWYAFINKLRDDPSQSSELLSEAKKLNDSQAPK | 860 |
| Z12425 | VDAKYAKEADEAAMEIADLPNLTWDQWFAFIDKLRDDPSQSSELLSEAKKLNDSQAPK | 861 |
| Z12426 | VDAKYAKEADNAAVEIAELPNLTWDQWDAFITKLRDDPSQSSELLSEAKKLNDSQAPK | 862 |
| Z12427 | VDAKYAKEADDAAYEIAFLPNLTWDQWAFILKLRDDPSQSSELLSEAKKLNDSQAPK | 863 |
| Z12428 | VDAKYAKEADNAALEIADLPNLTWDQWFAFIQKLRDDPSQSSELLSEAKKLNDSQAPK | 864 |
| Z12429 | VDAKYAKEADDAAYEIAAVEIAFLPNLTWDQWFAFISKLRDDPSQSSELLSEAKKLNDSQAPK | 865 |
| Z12430 | VDAKYAKEADGAAFEIAALPNLTWDQWFAFIDKLRDDPSQSSELLSEAKKLNDSQAPK | 866 |
| Z12431 | VDAKYAKEADDAAFEIAQLPNLTWDQWAAFIDKLRDDPSQSSELLSEAKKLNDSQAPK | 867 |
| Z12432 | VDAKYAKEADMAALEIADLPNLTWDQWYAFIEKLRDDPSQSSELLSEAKKLNDSQAPK | 868 |
| Z12433 | VDAKYAKEADVAAVEIAGLPNLTWDQWAFIEKLRDDPSQSSELLSEAKKLNDSQAPK | 869 |

FIG. 1EE

| | | |
|---|---|---|
| Z12434 | VDAKYAKEADIAAVEIAALPNLTWDQWDAFIDKLRDDPSQSSELLSEAKKLNDSQAPK | 870 |
| Z12435 | VDAKYAKEADDAALEIADLPNLTWDQWMAFIGKLRDDPSQSSELLSEAKKLNDSQAPK | 871 |
| Z12437 | VDAKYAKEADDAAYEIADLPNLTWDQWAFIDKLRDDPSQSSELLSEAKKLNDSQAPK | 872 |
| Z12438 | VDAKYAKEADNAAFEIAGLPNLTWDQWAFISKLRDDPSQSSELLSEAKKLNDSQAPK | 873 |
| Z12440 | VDAKYAKEADQAAMEIALLPNLTWDQWEAFILKLRDDPSQSSELLSEAKKLNDSQAPK | 874 |
| Z12441 | VDAKYAKEADDAAYEIALLPNLTWDQWAFIGKLRDDPSQSSELLSEAKKLNDSQAPK | 875 |
| Z12442 | VDAKYAKEADDAAFEIAELPNLTWDQWEAFIQKLRDDPSQSSELLSEAKKLNDSQAPK | 876 |
| Z12444 | VDAKYAKEADEAAVEIADLPNLTWDQWAFIEKLRDDPSQSSELLSEAKKLNDSQAPK | 877 |
| Z12445 | VDAKYAKEADDAAYEIANLPNLTWDQWAFINKLRDDPSQSSELLSEAKKLNDSQAPK | 878 |
| Z12446 | VDAKYAKEADQAAVEIADLPNLTWDQWEAFISKLRDDPSQSSELLSEAKKLNDSQAPK | 879 |
| Z12447 | VDAKYAKEADNAAFEIANLPNLTWMQWEAFIEKLRDDPSQSSELLSEAKKLNDSQAPK | 880 |
| Z12448 | VDAKYAKEADAAAVEIADLPNLTWYQWWAFIEKLRDDPSQSSELLSEAKKLNDSQAPK | 881 |
| Z12449 | VDAKYAKEADDAAYEIANLPNLTWDQWLAFITKLRDDPSQSSELLSEAKKLNDSQAPK | 882 |
| Z12450 | VDAKYAKEADDAAYEIAALPNLTWDQWAFIEKLRDDPSQSSELLSEAKKLNDSQAPK | 883 |
| Z12452 | VDAKYAKEADKAAYEIAELPNLTWDQWFAFIAKLRDDPSQSSELLSEAKKLNDSQAPK | 884 |
| Z12453 | VDAKYAKEADIAAVEIADLPNLTWDQWAFIQKLRDDPSQSSELLSEAKKLNDSQAPK | 885 |
| Z12454 | VDAKYAKEADDAAYEIAELPNLTWDQWMAFIDKLRDDPSQSSELLSEAKKLNDSQAPK | 886 |
| Z12455 | VDAKYAKEADNAAVEIAALPNLTWDQWAFIEKLRDDPSQSSELLSEAKKLNDSQAPK | 887 |
| Z12456 | VDAKYAKEADDAAVEIAELPNLTWDQWAFIAKLRDDPSQSSELLSEAKKLNDSQAPK | 888 |
| Z12457 | VDAKYAKEADKAAYEIAFLPNLTWDQWFAFINKLRDDPSQSSELLSEAKKLNDSQAPK | 889 |
| Z12458 | VDAKYAKEADDAAYEIAELPNLTWEQWFAFIAKLRDDPSQSSELLSEAKKLNDSQAPK | 890 |
| Z12459 | VDAKYAKEADDAAMEIAYLPNLTWDQWHAFIAKLRDDPSQSSELLSEAKKLNDSQAPK | 891 |
| Z12460 | VDAKYAKEADDAAFEIALLPNLTWDQWYAFIDKLRDDPSQSSELLSEAKKLNDSQAPK | 892 |
| Z12461 | VDAKYAKEADDAAFEIAMLPNLTWDQWFAFINKLRDDPSQSSELLSEAKKLNDSQAPK | 893 |
| Z12462 | VDAKYAKEADDAAFEIAMLPNLTWDQWMAFIEKLRDDPSQSSELLSEAKKLNDSQAPK | 894 |
| Z12464 | VDAKYAKEADEAAVEIAEAPNLTWDQWYAFIDKLRDDPSQSSELLSEAKKLNDSQAPK | 895 |
| Z12465 | VDAKYAKEADDAAFEIAMLPNLTWDQWFAFINKLRDDPSQSSELLSEAKKLNDSQAPK | 896 |
| Z12466 | VDAKYAKEADTAAVEIAFLPNLTWDQWMAFIEKLRDDPSQSSELLSEAKKLNDSQAPK | 897 |
| Z12467 | VDAKYAKEADLAAYEIAFLPNLTWDQWAFINKLRDDPSQSSELLSEAKKLNDSQAPK | 898 |

FIG. 1FF

| | | |
|---|---|---|
| Z12468 | VDAKYAKEADDAAYEIAYLPNLTWDQWWAAFISKLRDDPSQSSELLSEAKKLNDSQAPK | 899 |
| Z12469 | VDAKYAKEADDAAYEIAGLPNLTWDQWWAAFIEKLRDDPSQSSELLSEAKKLNDSQAPK | 900 |
| Z12470 | VDAKYAKEADNAAVEIAFLPNLTWDQWYAFIEKLRDDPSQSSELLSEAKKLNDSQAPK | 901 |
| Z12471 | VDAKYAKEADDAAYEIAYLPNLTWDQWYAFINKLRDDPSQSSELLSEAKKLNDSQAPK | 902 |
| Z12472 | VDAKYAKEADAALEIADLPNLTWWQWWAFIEKLRDDPSQSSELLSEAKKLNDSQAPK | 903 |
| Z12473 | VDAKYAKEADDAAVEIADLPNLTWWQWWAFIEKLRDDPSQSSELLSEAKKLNDSQAPK | 904 |
| Z12474 | VDAKYAKEADDAAMEIAGLPNLTWDQWWAAFIGKLRDDPSQSSELLSEAKKLNDSQAPK | 905 |
| Z12475 | VDAKYAKEADSAAYEIAQLPNLTWVQWAAFIDKLRDDPSQSSELLSEAKKLNDSQAPK | 906 |
| Z12476 | VDAKYAKEADDAAFEIAWLPNLTWDQWFAFISKLRDDPSQSSELLSEAKKLNDSQAPK | 907 |
| Z12477 | VDAKYAKEADEAAVEIAMLPNLTWDQWYAFIEKLRDDPSQSSELLSEAKKLNDSQAPK | 908 |
| Z12478 | VDAKYAKEADDAALEIASLPNLTWDQWLAFIDKLRDDPSQSSELLSEAKKLNDSQAPK | 909 |
| Z12479 | VDAKYAKEADDAAVEIAYLPNLTWDQWAAFIEKLRDDPSQSSELLSEAKKLNDSQAPK | 910 |
| Z12480 | VDAKYAKEADDAAVEIADLPNLTWDQWWAFIEKLRDDPSQSSELLSEAKKLNDSQAPK | 911 |
| Z12482 | VDAKYAKEADAAVEIAELPNLTWDQWAAFIQKLRDDPSQSSELLSEAKKLNDSQAPK | 912 |
| Z12483 | VDAKYAKEADDAAVEIAFLPNLTWDQWYAFIEKLRDDPSQSSELLSEAKKLNDSQAPK | 913 |
| Z12484 | VDAKYAKEADDAALAAVEIAFIADLPNLTWDQWYAFIDKLRDDPSQSSELLSEAKKLNDSQAPK | 914 |
| Z12485 | VDAKYAKEADDAAAAEIAVLPNLTWEQWWAFISKLRDDPSQSSELLSEAKKLNDSQAPK | 915 |
| Z12486 | VDAKYAKEADDAAMEIADLPNLTWDQWYAFIWKLRDDPSQSSELLSEAKKLNDSQAPK | 916 |
| Z12487 | VDAKYAKEADNAAVEIADLPNLTWDQWYAFIQKLRDDPSQSSELLSEAKKLNDSQAPK | 917 |
| Z12488 | VDAKYAKEADDAAYEIAFLPNLTWDQWWAFILKLRDDPSQSSELLSEAKKLNDSQAPK | 918 |
| Z12489 | VDAKYAKEADDAALAAYEIAYLPNLTWDQWFAFIYKLRDDPSQSSELLSEAKKLNDSQAPK | 919 |
| Z12490 | VDAKYAKEADKAAFEIAMLPNLTWDQWDAFIRKLRDDPSQSSELLSEAKKLNDSQAPK | 920 |
| Z12491 | VDAKYAKEADDAAFEIAFLPNLTWDQWFAFINKLRDDPSQSSELLSEAKKLNDSQAPK | 921 |
| Z12492 | VDAKYAKEADDAAFEIASLPNLTWDQWWAFIGKLRDDPSQSSELLSEAKKLNDSQAPK | 922 |
| Z12493 | VDAKYAKEADDAAFEIAWLPNLTWDQWWAFIDKLRDDPSQSSELLSEAKKLNDSQAPK | 923 |
| Z12494 | VDAKYAKEADDAAVEIAYLPNLTWDQWFAFIWKLRDDPSQSSELLSEAKKLNDSQAPK | 924 |
| Z12495 | VDAKYAKEADDAAFEIALLPNLTWDQWFAFIWKLRDDPSQSSELLSEAKKLNDSQAPK | 925 |
| Z12496 | VDAKYAKEADDAAFEIALLPNLTWDQWFAFIWKLRDDPSQSSELLSEAKKLNDSQAPK | 926 |
| Z12497 | VDAKYAKEADDAAFEIAALPNLTWDQWYAFILKLRDDPSQSSELLSEAKKLNDSQAPK | 927 |

FIG. 1GG

| | | |
|---|---|---|
| Z12499 | VDAKYAKEADMAAVEIAYLPNLTWDQWWAFIQKLRDDPSQSSELLSEAKKLNDSQAPK | 928 |
| Z12500 | VDAKYAKEADHAAMEIASLPNLTWDQWEAFIDKLRDDPSQSSELLSEAKKLNDSQAPK | 929 |
| Z12501 | VDAKYAKEADHAAYEIAALPNLTWDQWYAFINKLRDDPSQSSELLSEAKKLNDSQAPK | 930 |
| Z12502 | VDAKYAKEADEAAYEIADLPNLTWDQWYAFAFTKLRDDPSQSSELLSEAKKLNDSQAPK | 931 |
| Z12503 | VDAKYAKEADDAAYEIAELPNLTWDQWFAFITKLRDDPSQSSELLSEAKKLNDSQAPK | 932 |
| Z12504 | VDAKYAKEADNAAYEIAMLPNLTWDQWMAFIDKLRDDPSQSSELLSEAKKLNDSQAPK | 933 |
| Z12505 | VDAKYAKEADQAAVEIAALPNLTWEQWWAFITKLRDDPSQSSELLSEAKKLNDSQAPK | 934 |
| Z12506 | VDAKYAKEADIAAVEIAGLPNLTWDQWFAFIDKLRDDPSQSSELLSEAKKLNDSQAPK | 935 |
| Z12507 | VDAKYAKEADDAAYEIAMLPNLTWDQWFAFIQKLRDDPSQSSELLSEAKKLNDSQAPK | 936 |
| Z12508 | VDAKYAKEADEAAVEIANLPNLTWDQWDAFIWKLRDDPSQSSELLSEAKKLNDSQAPK | 937 |
| Z12509 | VDAKYAKEADDAAMEIADLPNLTWDQWFAFITKLRDDPSQSSELLSEAKKLNDSQAPK | 938 |
| Z12510 | VDAKYAKEADDAAFEIAHLPNLTWDQWFAFIGKLRDDPSQSSELLSEAKKLNDSQAPK | 939 |
| Z12511 | VDAKYAKEADRAAIEIADLPNLTWDQWWAFIEKLRDDPSQSSELLSEAKKLNDSQAPK | 940 |
| Z12512 | VDAKYAKEADEAAVEIAYLPNLTWDQWFAFINKLRDDPSQSSELLSEAKKLNDSQAPK | 941 |
| Z12513 | VDAKYAKEADSAAVEIAELPNLTWDQWFAFIEKLRDDPSQSSELLSEAKKLNDSQAPK | 942 |
| Z12514 | VDAKYAKEADDAAVEIAAYEIAYLPNLTWDQWFAFITKLRDDPSQSSELLSEAKKLNDSQAPK | 943 |
| Z12515 | VDAKYAKEADDAAAYEIAYLPNLTWDQWMAFIGKLRDDPSQSSELLSEAKKLNDSQAPK | 944 |
| Z12516 | VDAKYAKEADDAAYEIASLPNLTWDQWNAFIQKLRDDPSQSSELLSEAKKLNDSQAPK | 945 |
| Z12517 | VDAKYAKEADEAAFEIAHLPNLTWDQWFAFIHKLRDDPSQSSELLSEAKKLNDSQAPK | 946 |
| Z12518 | VDAKYAKEADDAAYEIAFLPNLTWDQWEAFITKLRDDPSQSSELLSEAKKLNDSQAPK | 947 |
| Z12519 | VDAKYAKEADDAAYEIADLPNLTWDQWFAFINKLRDDPSQSSELLSEAKKLNDSQAPK | 948 |
| Z12520 | VDAKYAKEADSAAYEIAGLPNLTWDQWEAFIRKLRDDPSQSSELLSEAKKLNDSQAPK | 949 |
| Z12521 | VDAKYAKEADEAAYEIASLPNLTWDQWHAFIQKLRDDPSQSSELLSEAKKLNDSQAPK | 950 |
| Z12523 | VDAKYAKEADDAAFEIADLPNLTWDQWAFIEKLRDDPSQSSELLSEAKKLNDSQAPK | 951 |
| Z12524 | VDAKYAKEADDAAYEIADLPNLTWDQWWAFIYKLRDDPSQSSELLSEAKKLNDSQAPK | 952 |
| Z12525 | VDAKYAKEADLAAMEIADLPNLTWDQWWAFINKLRDDPSQSSELLSEAKKLNDSQAPK | 953 |
| Z12526 | VDAKYAKEADQAAVEIAYLPNLTWDQWAFIEKLRDDPSQSSELLSEAKKLNDSQAPK | 954 |
| Z12527 | VDAKYAKEADDAAAIEIADLPNLTWDQWYAFIAKLRDDPSQSSELLSEAKKLNDSQAPK | 955 |
| Z12528 | VDAKYAKEADDAAMEIADLPNLTWDQWDAFIMKLRDDPSQSSELLSEAKKLNDSQAPK | 956 |

FIG. 1HH

| | | |
|---|---|---|
| Z12529 | VDAKYAKEADEAAVEIAYLPNLTWDQWFAFIQKLRDDPSQSSELLSEAKKLNDSQAPK | 957 |
| Z12530 | VDAKYAKEADNAAVEIAELPNLTWDQWFAFIEKLRDDPSQSSELLSEAKKLNDSQAPK | 958 |
| Z12531 | VDAKYAKEADDAAYEIAMLPNLTWDQWFAFIQKLRDDPSQSSELLSEAKKLNDSQAPK | 959 |
| Z12532 | VDAKYAKEADNAAMEIADLPNLTWDQWAAFIDKLRDDPSQSSELLSEAKKLNDSQAPK | 960 |
| Z12533 | VDAKYAKEADNAAVEIAYLPNLTWEQWFAFITKLRDDPSQSSELLSEAKKLNDSQAPK | 961 |
| Z12534 | VDAKYAKEADEAAFEIAWLPNLTWDQWYAFIEKLRDDPSQSSELLSEAKKLNDSQAPK | 962 |
| Z12535 | VDAKYAKEADEAAMEIAELPNLTWDQWMAFIGKLRDDPSQSSELLSEAKKLNDSQAPK | 963 |
| Z12536 | VDAKYAKEADDAAFEIAMLPNLTWDQWFAFIDKLRDDPSQSSELLSEAKKLNDSQAPK | 964 |
| Z12537 | VDAKYAKEADQAAMEIADLPNLTWDQWAAFINKLRDDPSQSSELLSEAKKLNDSQAPK | 965 |
| Z12538 | VDAKYAKEADDAAVEIAYLPNLTWDQWWAFINKLRDDPSQSSELLSEAKKLNDSQAPK | 966 |
| Z12539 | VDAKYAKEADDAAVEIAWLPNLTWDQWFAFIQKLRDDPSQSSELLSEAKKLNDSQAPK | 967 |
| Z12540 | VDAKYAKEADEAAFEIADLPNLTWDQWYAFIEKLRDDPSQSSELLSEAKKLNDSQAPK | 968 |
| Z12541 | VDAKYAKEADEAAVEIADLPNLTWDQWFAFIEKLRDDPSQSSELLSEAKKLNDSQAPK | 969 |
| Z12542 | VDAKYAKEADQAAFEIAGLPNLTWEQWFAFIEKLRDDPSQSSELLSEAKKLNDSQAPK | 970 |
| Z12543 | VDAKYAKEADDAAYEIAYLPNLTWLQWEAFIMKLRDDPSQSSELLSEAKKLNDSQAPK | 971 |
| Z12544 | VDAKYAKEADDAAFEIASLPNLTWDQWFAFIEKLRDDPSQSSELLSEAKKLNDSQAPK | 972 |
| Z12545 | VDAKYAKEADEAAVEIAALPNLTWDQWMAFIDKLRDDPSQSSELLSEAKKLNDSQAPK | 973 |
| Z12546 | VDAKYAKEADDAAYEIAELPNLTWDQWYAFIAKLRDDPSQSSELLSEAKKLNDSQAPK | 974 |
| Z12547 | VDAKYAKEADEAAVEIAELPNLTWDQWWAFIEKLRDDPSQSSELLSEAKKLNDSQAPK | 975 |
| Z12548 | VDAKYAKEADEAAMEIAAMEIAAFEIAAFEIAMLPNLTWDQWFAFIGKLRDDPSQSSELLSEAKKLNDSQAPK | 976 |
| Z12549 | VDAKYAKEADDAAYEIAMLPNLTWDQWFAFIEKLRDDPSQSSELLSEAKKLNDSQAPK | 977 |
| Z12550 | VDAKYAKEADDAAVEIADLPNLTWDQWMAFINKLRDDPSQSSELLSEAKKLNDSQAPK | 978 |
| Z12551 | VDAKYAKEADDAAYEIAQLPNLTWDQWAAFIWKLRDDPSQSSELLSEAKKLNDSQAPK | 979 |
| Z12552 | VDAKYAKEADDAAVEIAALPNLTWDQWFAFIDKLRDDPSQSSELLSEAKKLNDSQAPK | 980 |
| Z12553 | VDAKYAKEADDAAYEIADLPNLTWDQWYAFIEKLRDDPSQSSELLSEAKKLNDSQAPK | 981 |
| Z12554 | VDAKYAKEADDAAYEIAFLPNLTWDQWAAFIEKLRDDPSQSSELLSEAKKLNDSQAPK | 982 |
| Z12555 | VDAKYAKEADDAAYEIAFLPNLTWEQWYAFIAKLRDDPSQSSELLSEAKKLNDSQAPK | 983 |
| Z12556 | VDAKYAKEADDAAMEIADLPNLTWEQWYAFIAKLRDDPSQSSELLSEAKKLNDSQAPK | 984 |
| Z12557 | VDAKYAKEADQAAMEIADLPNLTWLQWFAFINKLRDDPSQSSELLSEAKKLNDSQAPK | 985 |

FIG. 1III

| | | |
|---|---|---|
| Z12558 | VDAKYAKEADDAAVEIAELPNLTWEQWFAFIDKLRDDPSQSSELLSEAKKLNDSQAPK | 986 |
| Z12559 | VDAKYAKEADMAAIEIAALPNLTWDQWDAFIRKLRDDPSQSSELLSEAKKLNDSQAPK | 987 |
| Z12560 | VDAKYAKEADEAAVEIAYLPNLTWDQWVAFISKLRDDPSQSSELLSEAKKLNDSQAPK | 988 |
| Z12561 | VDAKYAKEADQAAVEIAELPNLTWDQWWAFINKLRDDPSQSSELLSEAKKLNDSQAPK | 989 |
| Z12562 | VDAKYAKEADDAAIEIANLPNLTWEQWFAFINKLRDDPSQSSELLSEAKKLNDSQAPK | 990 |
| Z12563 | VDAKYAKEADQAAFEIAELPNLTWDQWYAFIAKLRDDPSQSSELLSEAKKLNDSQAPK | 991 |
| Z12564 | VDAKYAKEADDAAYEIAELPNLTWDQWWAFITKLRDDPSQSSELLSEAKKLNDSQAPK | 992 |
| Z12565 | VDAKYAKEADDAAYEIAELPNLTWDQWFAFIGKLRDDPSQSSELLSEAKKLNDSQAPK | 993 |
| Z12566 | VDAKYAKEADDAAYEIAMLPNLTWDQWYAFINKLRDDPSQSSELLSEAKKLNDSQAPK | 994 |
| Z12567 | VDAKYAKEADAAMEIALLPNLTWDQWAFIEKLRDDPSQSSELLSEAKKLNDSQAPK | 995 |
| Z12568 | VDAKYAKEADAAVEIADLPNLTWDQWFAFIGKLRDDPSQSSELLSEAKKLNDSQAPK | 996 |
| Z12569 | VDAKYAKEADDAAVEIADLPNLTWDQWYAFIAKLRDDPSQSSELLSEAKKLNDSQAPK | 997 |
| Z12570 | VDAKYAKEADEAAMEIAELPNLTWDQWWAFITKLRDDPSQSSELLSEAKKLNDSQAPK | 998 |
| Z12571 | VDAKYAKEADNAAVEIADLPNLTWDQWYAFINKLRDDPSQSSELLSEAKKLNDSQAPK | 999 |
| Z12572 | VDAKYAKEADDAAYEIAFLPNLTWDQWYAFIDKLRDDPSQSSELLSEAKKLNDSQAPK | 1000 |
| Z12573 | VDAKYAKEADDAAYEIADLPNLTWDQWFAFIEKLRDDPSQSSELLSEAKKLNDSQAPK | 1001 |
| Z12574 | VDAKYAKEADNAAAEIADLPNLTWDQWWAFILKLRDDPSQSSELLSEAKKLNDSQAPK | 1002 |
| Z12575 | VDAKYAKEADEAAVEIAFLPNLTWDQWWAFITKLRDDPSQSSELLSEAKKLNDSQAPK | 1003 |
| Z12576 | VDAKYAKEADDAAVEIADLPNLTWDQWFAFINKLRDDPSQSSELLSEAKKLNDSQAPK | 1004 |
| Z12577 | VDAKYAKEADEAAVEIADLPNLTWDQWFAFIGKLRDDPSQSSELLSEAKKLNDSQAPK | 1005 |
| Z12578 | VDAKYAKEADDAAYEIAMLPNLTWDQWAAFIDKLRDDPSQSSELLSEAKKLNDSQAPK | 1006 |
| Z12579 | VDAKYAKEADDAAYEIAQLPNLTWEQWFAFIDKLRDDPSQSSELLSEAKKLNDSQAPK | 1007 |
| Z12580 | VDAKYAKEADGAAYEIAGLPNLTWDQWFAFINKLRDDPSQSSELLSEAKKLNDSQAPK | 1008 |
| Z12581 | VDAKYAKEADNAAYEIALLPNLTWDQWEAFILKLRDDPSQSSELLSEAKKLNDSQAPK | 1009 |
| Z12582 | VDAKYAKEADAAAMEIAGLPNLTWDQWFAFISKLRDDPSQSSELLSEAKKLNDSQAPK | 1010 |
| Z12583 | VDAKYAKEADDAAVEIANLPNLTWDQWAAFIMKLRDDPSQSSELLSEAKKLNDSQAPK | 1011 |
| Z12584 | VDAKYAKEADEAAVEIAELPNLTWDQWAFINKLRDDPSQSSELLSEAKKLNDSQAPK | 1012 |
| Z12586 | VDAKYAKEADDAAFEIAMLPNLTWDQWYAFIQKLRDDPSQSSELLSEAKKLNDSQAPK | 1013 |
| Z12588 | VDAKYAKEADMAAVEIAELPNLTWEQWYAFIEKLRDDPSQSSELLSEAKKLNDSQAPK | 1014 |

FIG. 1JJ

| ID | Sequence | SEQ ID |
|---|---|---|
| Z12589 | VDAKYAKEADMAAVEIADLPNLTWDQWYAFIWKLRDDPSQSSELLSEAKKLNDSQAPK | 1015 |
| Z12590 | VDAKYAKEADARAMEIADLPNLTWDQWWAFITKLRDDPSQSSELLSEAKKLNDSQAPK | 1016 |
| Z12591 | VDAKYAKEADDAAYEIAFLPNLTWDQWWAFILKLRDDPSQSSELLSEAKKLNDSQAPK | 1017 |
| Z12592 | VDAKYAKEADQAAMEIAELPNLTWDQWEAFILKLRDDPSQSSELLSEAKKLNDSQAPK | 1018 |
| Z12593 | VDAKYAKEADGAAYEIASLPNLTWDQWYAFIEKLRDDPSQSSELLSEAKKLNDSQAPK | 1019 |
| Z12594 | VDAKYAKEADDAAYEIAFLPNLTWDQWDAFIMKLRDDPSQSSELLSEAKKLNDSQAPK | 1020 |
| Z12595 | VDAKYAKEADDAAVELAWLPNLTWDQWWAFIQKLRDDPSQSSELLSEAKKLNDSQAPK | 1021 |
| Z12596 | VDAKYAKEADEAAVEIAYLPNLTWDQWWAFINKLRDDPSQSSELLSEAKKLNDSQAPK | 1022 |
| Z12597 | VDAKYAKEADARAFEIAALPNLTWDQWYAFIGKLRDDPSQSSELLSEAKKLNDSQAPK | 1023 |
| Z12598 | VDAKYAKEADDAAYEIAELPNLTWDQWYAFIMKLRDDPSQSSELLSEAKKLNDSQAPK | 1024 |
| Z12599 | VDAKYAKEADEAAYEIAALPNLTWDQWYAFIMKLRDDPSQSSELLSEAKKLNDSQAPK | 1025 |
| Z12600 | VDAKYAKEADDAAVEIAALPNLTWDQWIAFIDKLRDDPSQSSELLSEAKKLNDSQAPK | 1026 |
| Z12601 | VDAKYAKEADEAAMEIADLPNLTWEQWYAFIDKLRDDPSQSSELLSEAKKLNDSQAPK | 1027 |
| Z12603 | VDAKYAKEADAAAVEIARLPNLTWLQWEAFILKLRDDPSQSSELLSEAKKLNDSQAPK | 1028 |
| Z12604 | VDAKYAKEADARAVEIAELPNLTWEQWWAFIQKLRDDPSQSSELLSEAKKLNDSQAPK | 1029 |
| Z12605 | VDAKYAKEADAAAYEIAHLPNLTWDQWYAFILKLRDDPSQSSELLSEAKKLNDSQAPK | 1030 |
| Z12606 | VDAKYAKEADDAAMEIAALPNLTWDQWFAFIHKLRDDPSQSSELLSEAKKLNDSQAPK | 1031 |
| Z12607 | VDAKYAKEADDAAFEIAFLPNLTWDQWHAFIEKLRDDPSQSSELLSEAKKLNDSQAPK | 1032 |
| Z12608 | VDAKYAKEADNAAVEIAALPNLTWIQWHAFIEKLRDDPSQSSELLSEAKKLNDSQAPK | 1033 |
| Z12609 | VDAKYAKEADSAAVEIAVLPNLTWDQWYAFILKLRDDPSQSSELLSEAKKLNDSQAPK | 1034 |
| Z12610 | VDAKYAKEADEAAVEIAHLPNLTWDQWEAFIGKLRDDPSQSSELLSEAKKLNDSQAPK | 1035 |
| Z12611 | VDAKYAKEADDAAMEIAVLPNLTWDQWFAFIHKLRDDPSQSSELLSEAKKLNDSQAPK | 1036 |
| Z12612 | VDAKYAKEADDAAMEIAELPNLTWEQWFAFIHKLRDDPSQSSELLSEAKKLNDSQAPK | 1037 |
| Z12613 | VDAKYAKEADDAAFEIAQLPNLTWDQWYAFIDKLRDDPSQSSELLSEAKKLNDSQAPK | 1038 |
| Z12614 | VDAKYAKEADNAAMEIAELPNLTWDQWWAFIRKLRDDPSQSSELLSEAKKLNDSQAPK | 1039 |
| Z12615 | VDAKYAKEADDAAYEIAELPNLTWDQWYAFITKLRDDPSQSSELLSEAKKLNDSQAPK | 1040 |
| Z12616 | VDAKYAKEADNAALEIAELPNLTWDQWWAFIRKLRDDPSQSSELLSEAKKLNDSQAPK | 1041 |
| Z12617 | VDAKYAKEADNAAYEIAELPNLTWDQWYAFIINKLRDDPSQSSELLSEAKKLNDSQAPK | 1042 |
| Z12618 | VDAKYAKEADLAAMEIAELPNLTWDQWYAFINKLRDDPSQSSELLSEAKKLNDSQAPK | 1043 |

FIG. 1KK

| | | |
|---|---|---|
| Z12619 | VDAKYAKEADDAAVEIADLPNLTWAQWYAFINKLRDDPSQSSELLSEAKKLNDSQAPK | 1044 |
| Z12620 | VDAKYAKEADDAAMEIAFLPNLTWDQWWAFIMKLRDDPSQSSELLSEAKKLNDSQAPK | 1045 |
| Z12621 | VDAKYAKEADEAAVEIAHLPNLTWDQWFAFITKLRDDPSQSSELLSEAKKLNDSQAPK | 1046 |
| Z12622 | VDAKYAKEADDAAYEIAFLPNLTWDQWFAFIGKLRDDPSQSSELLSEAKKLNDSQAPK | 1047 |
| Z12624 | VDAKYAKEADHAAYEIAFLPNLTWDQWFAFIEKLRDDPSQSSELLSEAKKLNDSQAPK | 1048 |
| Z12625 | VDAKYAKEADQAAVEIANLPNLTWDQWAAFIMKLRDDPSQSSELLSEAKKLNDSQAPK | 1049 |
| Z12626 | VDAKYAKEADQAAYEIAGLPNLTWDQWAAFTEKLRDDPSQSSELLSEAKKLNDSQAPK | 1050 |
| Z12627 | VDAKYAKEADEAAVEIALLPNLTWDQWFAFIDKLRDDPSQSSELLSEAKKLNDSQAPK | 1051 |
| Z12628 | VDAKYAKEADEAAYEIAYLPNLTWDQWYAFISKLRDDPSQSSELLSEAKKLNDSQAPK | 1052 |
| Z12629 | VDAKYAKEADEAAVEIAELPNLTWDQWEAFILKLRDDPSQSSELLSEAKKLNDSQAPK | 1053 |
| Z12630 | VDAKYAKEADDAAMEIAELPNLTWDQWWAFIAKLRDDPSQSSELLSEAKKLNDSQAPK | 1054 |
| Z12631 | VDAKYAKEADDAALEIAYLPNLTWDQWWAFITKLRDDPSQSSELLSEAKKLNDSQAPK | 1055 |
| Z12632 | VDAKYAKEADDAAVEIADLPNLTWDQWWAFIDKLRDDPSQSSELLSEAKKLNDSQAPK | 1056 |
| Z12633 | VDAKYAKEADSAAVEIADLPNLTWDQWYAFIGKLRDDPSQSSELLSEAKKLNDSQAPK | 1057 |
| Z12635 | VDAKYAKEADMAAVEIAELPNLTWDQWYAFIQKLRDDPSQSSELLSEAKKLNDSQAPK | 1058 |
| Z12636 | VDAKYAKEADKAAVEIAELPNLTWDQWFAFIQKLRDDPSQSSELLSEAKKLNDSQAPK | 1059 |
| Z12637 | VDAKYAKEADDAAMEIADLPNLTWDQWHAFIQKLRDDPSQSSELLSEAKKLNDSQAPK | 1060 |
| Z12638 | VDAKYAKEADDAAVEIADLPNLTWDQWFAFITKLRDDPSQSSELLSEAKKLNDSQAPK | 1061 |
| Z12639 | VDAKYAKEADDAAYEIAGLPNLTWDQWAAFIDKLRDDPSQSSELLSEAKKLNDSQAPK | 1062 |
| Z12640 | VDAKYAKEADDIAAFEIAAFEIAGLPNLTWDQWYAFITKLRDDPSQSSELLSEAKKLNDSQAPK | 1063 |
| Z12641 | VDAKYAKEADIAAFEIAAFEIAGLPNLTWDQWYAFIAKLRDDPSQSSELLSEAKKLNDSQAPK | 1064 |
| Z12642 | VDAKYAKEADQAAVEIAFLPNLTWDQWYAFIMKLRDDPSQSSELLSEAKKLNDSQAPK | 1065 |
| Z12643 | VDAKYAKEADMAAVEIAGLPNLTWDQWAAFIDKLRDDPSQSSELLSEAKKLNDSQAPK | 1066 |
| Z12644 | VDAKYAKEADDAAMEIAALPNLTWDQWWAFIDKLRDDPSQSSELLSEAKKLNDSQAPK | 1067 |
| Z12645 | VDAKYAKEADDAAVEIAWLPNLTWDQWYAFINKLRDDPSQSSELLSEAKKLNDSQAPK | 1068 |
| Z12646 | VDAKYAKEADNAAYEIAFLPNLTWDQWFAFINKLRDDPSQSSELLSEAKKLNDSQAPK | 1069 |
| Z12648 | VDAKYAKEADDAAFEIAALPNLTWDQWWAFIEKLRDDPSQSSELLSEAKKLNDSQAPK | 1070 |
| Z12649 | VDAKYAKEADDAAYEIAELPNLTWDQWYAFIEKLRDDPSQSSELLSEAKKLNDSQAPK | 1071 |
| Z12650 | VDAKYAKEADDAAYEIAFLPNLTWDQWDAFIEKLRDDPSQSSELLSEAKKLNDSQAPK | 1072 |

FIG. 1LL

| | | |
|---|---|---|
| Z12651 | VDAKYAKEADDAAVEIAEFLPNLTWEQWYAFIEKLRDDPSQSSELLSEAKKLNDSQAPK | 1073 |
| Z12652 | VDAKYAKEADNAAMEIAALPNLTWDQWYAFINKLRDDPSQSSELLSEAKKLNDSQAPK | 1074 |
| Z12653 | VDAKYAKEADDAAVEIAFLPNLTWDQWDAFINKLRDDPSQSSELLSEAKKLNDSQAPK | 1075 |
| Z12654 | VDAKYAKEADAAAYEIALLPNLTWDQWFAFIDKLRDDPSQSSELLSEAKKLNDSQAPK | 1076 |
| Z12655 | VDAKYAKEADDAAYEIAGLPNLTWDQWAFISKLRDDPSQSSELLSEAKKLNDSQAPK | 1077 |
| Z12656 | VDAKYAKEADDAAFEIAELPNLTWDQWWAFITKLRDDPSQSSELLSEAKKLNDSQAPK | 1078 |
| Z12657 | VDAKYAKEADEAAMEIADLPNLTWAQWYAFIDKLRDDPSQSSELLSEAKKLNDSQAPK | 1079 |
| Z12658 | VDAKYAKEADMAAVEIAALPNLTWDQWYAFIEKLRDDPSQSSELLSEAKKLNDSQAPK | 1080 |
| Z12659 | VDAKYAKEADNAAVEIAELPNLTWEQWAFINKLRDDPSQSSELLSEAKKLNDSQAPK | 1081 |
| Z12660 | VDAKYAKEADIAAVEIALLPNLTWDQWAAFISKLRDDPSQSSELLSEAKKLNDSQAPK | 1082 |
| Z12661 | VDAKYAKEADRAAVEIASLPNLTWANLPNLTWDQWYAFITKLRDDPSQSSELLSEAKKLNDSQAPK | 1083 |
| Z12662 | VDAKYAKEADAAAVEIANLPNLTWDQWEAFIHKLRDDPSQSSELLSEAKKLNDSQAPK | 1084 |
| Z12663 | VDAKYAKEADDAAVEIANLPNLTWDQWFAFIMKLRDDPSQSSELLSEAKKLNDSQAPK | 1085 |
| Z12664 | VDAKYAKEADNAAVEIAWLPNLTWAQWHAFIQKLRDDPSQSSELLSEAKKLNDSQAPK | 1086 |
| Z12665 | VDAKYAKEADFAAIEIAELPNLTWDQWFAFITKLRDDPSQSSELLSEAKKLNDSQAPK | 1087 |
| Z12669 | VDAKYAKEADIAAFEIAMLPNLTWDQWHAFIAKLRDDPSQSSELLSEAKKLNDSQAPK | 1088 |
| Z12670 | VDAKYAKEADIAAFEIAMLPNLTWLQWEAFIAKLRDDPSQSSELLSEAKKLNDSQAPK | 1089 |
| Z12671 | VDAKYAKEADGAAMEIALLPNLTWDQWYAFINKLRDDPSQSSELLSEAKKLNDSQAPK | 1090 |
| Z12672 | VDAKYAKEADAAAMEIAFLPNLTWDQWDAFILKLRDDPSQSSELLSEAKKLNDSQAPK | 1091 |
| Z12673 | VDAKYAKEADAAAMEIANLPNLTWDQWYAFIRKLRDDPSQSSELLSEAKKLNDSQAPK | 1092 |
| Z12674 | VDAKYAKEADDAAYEIAGLPNLTWDQWYAFIQKLRDDPSQSSELLSEAKKLNDSQAPK | 1093 |
| Z12675 | VDAKYAKEADLAAIEIANLPNLTWDQWHAFIFKLRDDPSQSSELLSEAKKLNDSQAPK | 1094 |
| Z12677 | VDAKYAKEADRAAYEIAEAFLPNLTWDQWYAFISKLRDDPSQSSELLSEAKKLNDSQAPK | 1095 |
| Z12679 | VDAKYAKEADAAAVEIAAFLPNLTWDQWIDAFIFKLRDDPSQSSELLSEAKKLNDSQAPK | 1096 |
| Z12680 | VDAKYAKEADHAAVEIAGLPNLTWDQWHAFISKLRDDPSQSSELLSEAKKLNDSQAPK | 1097 |
| Z12681 | VDAKYAKEADAAAVEIAAALPNLTWDQWYAFIQKLRDDPSQSSELLSEAKKLNDSQAPK | 1098 |
| Z12683 | VDAKYAKEADTAAVEIAQLPNLTWDQWAAFIQKLRDDPSQSSELLSEAKKLNDSQAPK | 1099 |
| Z12684 | VDAKYAKEADRAAVEIAHLPNLTWIQWEAFINKLRDDPSQSSELLSEAKKLNDSQAPK | 1100 |
| Z12685 | VDAKYAKEADSAAVEIAELPNLTWDQWAFIRKLRDDPSQSSELLSEAKKLNDSQAPK | 1101 |

FIG. 1MM

| | | |
|---|---|---|
| Z12686 | VDAKYAKEADQAAFEIAGLPNLTWDQWFAFIRKLRDDPSQSSELLSEAKKLNDSQAPK | 1102 |
| Z12688 | VDAKYAKEADEAAVEIAALPNLTWDQWLAFILKLRDDPSQSSELLSEAKKLNDSQAPK | 1103 |
| Z12689 | VDAKYAKEADNAAVEIANLPNLTWLQWWAFINKLRDDPSQSSELLSEAKKLNDSQAPK | 1104 |
| Z12690 | VDAKYAKEADIAALEIANLPNLTWDQWWAFITKLRDDPSQSSELLSEAKKLNDSQAPK | 1105 |
| Z12691 | VDAKYAKEADIAAVEIAWLPNLTWAQWHAFITKLRDDPSQSSELLSEAKKLNDSQAPK | 1106 |
| Z12692 | VDAKYAKEADVAAAEIAELPNLTWDQWWAFIAKLRDDPSQSSELLSEAKKLNDSQAPK | 1107 |
| Z12694 | VDAKYAKEADDAAVEIAELPNLTWMQWEAFISKLRDDPSQSSELLSEAKKLNDSQAPK | 1108 |
| Z12696 | VDAKYAKEADQAAMEIAKLPNLTWDQWYAFITKLRDDPSQSSELLSEAKKLNDSQAPK | 1109 |
| Z12697 | VDAKYAKEADQAAYEIADLPNLTWDQWFAFINKLRDDPSQSSELLSEAKKLNDSQAPK | 1110 |
| Z12700 | VDAKYAKEADKAAYEIAQLPNLTWEQWWAFIDKLRDDPSQSSELLSEAKKLNDSQAPK | 1111 |
| Z12701 | VDAKYAKEADDAAVEIAWLPNLTWDQWYAFITKLRDDPSQSSELLSEAKKLNDSQAPK | 1112 |
| Z12703 | VDAKYAKEADDAAVEIANLPNLTWWQWEAFIAKLRDDPSQSSELLSEAKKLNDSQAPK | 1113 |
| Z12707 | VDAKYAKEADRAAVEIAEAMEIANLPNLTWEQWWAFIQKLRDDPSQSSELLSEAKKLNDSQAPK | 1114 |
| Z12708 | VDAKYAKEADTAAVEIAAYEIANLPNLTWDQWFAFIEKLRDDPSQSSELLSEAKKLNDSQAPK | 1115 |
| Z12709 | VDAKYAKEADDAAIEIADLPNLTWIQWLAFINKLRDDPSQSSELLSEAKKLNDSQAPK | 1116 |
| Z12711 | VDAKYAKEADDAAIEIALLPNLTWFQWDAFINKLRDDPSQSSELLSEAKKLNDSQAPK | 1117 |
| Z12712 | VDAKYAKEADRAAMEIASLPNLTWDQWWAFIQKLRDDPSQSSELLSEAKKLNDSQAPK | 1118 |
| Z12715 | VDAKYAKEADKAAVEIAQLPNLTWDQWWAFIMKLRDDPSQSSELLSEAKKLNDSQAPK | 1119 |
| Z12717 | VDAKYAKEADMAALEIAELPNLTWDQWYAFIDKLRDDPSQSSELLSEAKKLNDSQAPK | 1120 |
| Z12718 | VDAKYAKEADGAAVEIAMLPNLTWDQWWAFITKLRDDPSQSSELLSEAKKLNDSQAPK | 1121 |
| Z12719 | VDAKYAKEADDAAYEIAELPNLTWDQWYAFIEKLRDDPSQSSELLSEAKKLNDSQAPK | 1122 |
| Z12720 | VDAKYAKEADNAAYEIAAVEIAELPNLTWDQWFAFIEKLRDDPSQSSELLSEAKKLNDSQAPK | 1123 |
| Z12721 | VDAKYAKEADAAAVEIAELPNLTWDQWLAFISKLRDDPSQSSELLSEAKKLNDSQAPK | 1124 |
| Z12722 | VDAKYAKEADSAAYEIAGLPNLTWDQWDAFISKLRDDPSQSSELLSEAKKLNDSQAPK | 1125 |
| Z12723 | VDAKYAKEADGAAYEIALLPNLTWDQWAAFIDKLRDDPSQSSELLSEAKKLNDSQAPK | 1126 |
| Z12724 | VDAKYAKEADSAAIEIAYLPNLTWDQWYAFIEKLRDDPSQSSELLSEAKKLNDSQAPK | 1127 |
| Z12725 | VDAKYAKEADLAAIEIAYLPNLTWDQWAAFIRKLRDDPSQSSELLSEAKKLNDSQAPK | 1128 |
| Z12726 | VDAKYAKEADDAAVEIAYLPNLTWEQWWAFIKKLRDDPSQSSELLSEAKKLNDSQAPK | 1129 |
| Z12727 | VDAKYAKEADEAAVEIAVLPNLTWEQWFAFIMKLRDDPSQSSELLSEAKKLNDSQAPK | 1130 |

FIG. 1NN

| | | |
|---|---|---|
| Z12728 | VDAKYAKEADDAAMEIAMLPNLTWDQWYAFTEKLRDDPSQSSELLSEAKKLNDSQAPK | 1131 |
| Z12730 | VDAKYAKEADEAAMEIAALPNLTWDQWYAFIGKLRDDPSQSSELLSEAKKLNDSQAPK | 1132 |
| Z12732 | VDAKYAKEADFAAFEIAELPNLTWEQWFAFINKLRDDPSQSSELLSEAKKLNDSQAPK | 1133 |
| Z12733 | VDAKYAKEADNAAMEIANLPNLTWAQWAAFIGKLRDDPSQSSELLSEAKKLNDSQAPK | 1134 |
| Z12734 | VDAKYAKEADDAAVEIANLPNLTWIQWEAFIQKLRDDPSQSSELLSEAKKLNDSQAPK | 1135 |
| Z12735 | VDAKYAKEADDAALEIAQLPNLTWDQWEAFILKLRDDPSQSSELLSEAKKLNDSQAPK | 1136 |
| Z12737 | VDAKYAKEADDAAFEIAHLPNLTWLQWAAFIKKLRDDPSQSSELLSEAKKLNDSQAPK | 1137 |
| Z12738 | VDAKYAKEADEAAMEIALLPNLTWDQWWAFITKLRDDPSQSSELLSEAKKLNDSQAPK | 1138 |
| Z12740 | VDAKYAKEADLAAMEIAELPNLTWDQWFAFIYKLRDDPSQSSELLSEAKKLNDSQAPK | 1139 |
| Z12741 | VDAKYAKEADHAAVEIAILPNLTWAQWMAFIEKLRDDPSQSSELLSEAKKLNDSQAPK | 1140 |
| Z12742 | VDAKYAKEADKAAVEIANLPNLTWIQWWAFIRKLRDDPSQSSELLSEAKKLNDSQAPK | 1141 |
| Z12743 | VDAKYAKEADKAAFEIAILPNLTWYQWYAFIWKLRDDPSQSSELLSEAKKLNDSQAPK | 1142 |
| Z12744 | VDAKYAKEADEAAVEIAELPNLTWDQWNAFIMKLRDDPSQSSELLSEAKKLNDSQAPK | 1143 |
| Z12746 | VDAKYAKEADRAAVEIAHLPNLTWDQWFAFTEKLRDDPSQSSELLSEAKKLNDSQAPK | 1144 |
| Z12747 | VDAKYAKEADGAAMEIAELPNLTWDQWDAFIRKLRDDPSQSSELLSEAKKLNDSQAPK | 1145 |
| Z12749 | VDAKYAKEADMAAIEIADLPNLTWYQWYAFISKLRDDPSQSSELLSEAKKLNDSQAPK | 1146 |
| Z12750 | VDAKYAKEADKAAVEIAMLPNLTWDQWYAFIMKLRDDPSQSSELLSEAKKLNDSQAPK | 1147 |
| Z12751 | VDAKYAKEADRAAVEIAYLPNLTWDQWWAFIQKLRDDPSQSSELLSEAKKLNDSQAPK | 1148 |
| Z12752 | VDAKYAKEADDAAMEIAWLPNLTWYQWWAFIQKLRDDPSQSSELLSEAKKLNDSQAPK | 1149 |
| Z12754 | VDAKYAKEADMAAYEIAGLPNLTWDQWWAFIDKLRDDPSQSSELLSEAKKLNDSQAPK | 1150 |
| Z12755 | VDAKYAKEADHAALEIAELPNLTWDQWAAFINKLRDDPSQSSELLSEAKKLNDSQAPK | 1151 |
| Z12756 | VDAKYAKEADTAAVEIAMLPNLTWWQWEAFIMKLRDDPSQSSELLSEAKKLNDSQAPK | 1152 |
| Z12758 | VDAKYAKEADEAAYEIAFLPNLTWDQWAAFIYKLRDDPSQSSELLSEAKKLNDSQAPK | 1153 |
| Z12759 | VDAKYAKEADSAAYEIAALPNLTWDQWWAFIQKLRDDPSQSSELLSEAKKLNDSQAPK | 1154 |
| Z12760 | VDAKYAKEADNAAMEIAHLPNLTWDQWYAFIAKLRDDPSQSSELLSEAKKLNDSQAPK | 1155 |
| Z12761 | VDAKYAKEADKAAFEIAALPNLTWVQWMAFIAKLRDDPSQSSELLSEAKKLNDSQAPK | 1156 |
| Z12762 | VDAKYAKEADDAAVEIAHLPNLTWDQWEAFIFKLRDDPSQSSELLSEAKKLNDSQAPK | 1157 |
| Z12763 | VDAKYAKEADFAALEIASLPNLTWAQWYAFINKLRDDPSQSSELLSEAKKLNDSQAPK | 1158 |
| Z12765 | VDAKYAKEADHAAMEIAELPNLTWLQWHAFIAKLRDDPSQSSELLSEAKKLNDSQAPK | 1159 |

FIG. 100

| | | |
|---|---|---|
| Z12766 | VDAKYAKEADHAAVEIANLPNLTWDQWHAFISKLRDDPSQSSELLSEAKKLNDSQAPK | 1160 |
| Z12767 | VDAKYAKEADKAAFEIAFLPNLTWDQWDAFIAKLRDDPSQSSELLSEAKKLNDSQAPK | 1161 |
| Z12768 | VDAKYAKEADLAAFEIAFLPNLTWEQWFAFITKLRDDPSQSSELLSEAKKLNDSQAPK | 1162 |
| Z12770 | VDAKYAKEADSAAMEIAVLPNLTWDQWFAFIMKLRDDPSQSSELLSEAKKLNDSQAPK | 1163 |
| Z12771 | VDAKYAKEADAAAAEIADLPNLTWIQWDAFIHKLRDDPSQSSELLSEAKKLNDSQAPK | 1164 |
| Z12772 | VDAKYAKEADFAAYEIADLPNLTWYQWHAFIQKLRDDPSQSSELLSEAKKLNDSQAPK | 1165 |
| Z12773 | VDAKYAKEADQAAYEIADLPNLTWDQWDAFILKLRDDPSQSSELLSEAKKLNDSQAPK | 1166 |
| Z12775 | VDAKYAKEADFAAMEIADLPNLTWDQWAFITKLRDDPSQSSELLSEAKKLNDSQAPK | 1167 |
| Z12776 | VDAKYAKEADMAAFEIAFLPNLTWDQWYAFIQKLRDDPSQSSELLSEAKKLNDSQAPK | 1168 |
| Z12777 | VDAKYAKEADKAAVEIADLPNLTWDQWMQAFIQKLRDDPSQSSELLSEAKKLNDSQAPK | 1169 |
| Z12778 | VDAKYAKEADDAAIEIADLPNLTWDQWEAFILKLRDDPSQSSELLSEAKKLNDSQAPK | 1170 |
| Z12780 | VDAKYAKEADVAAVEIAELPNLTWDQWWAFIDKLRDDPSQSSELLSEAKKLNDSQAPK | 1171 |
| Z12781 | VDAKYAKEADQAAMEIAALPNLTWDQWDAFIGKLRDDPSQSSELLSEAKKLNDSQAPK | 1172 |
| Z12782 | VDAKYAKEADAAAVEIAYLPNLTWDQWFAFIMKLRDDPSQSSELLSEAKKLNDSQAPK | 1173 |
| Z12783 | VDAKYAKEADNAAMEIAELPNLTWIQWYAFINKLRDDPSQSSELLSEAKKLNDSQAPK | 1174 |
| Z12784 | VDAKYAKEADQAAYEIASLPNLTWDQWLAFIDKLRDDPSQSSELLSEAKKLNDSQAPK | 1175 |
| Z12785 | VDAKYAKEADGAAMEIAELPNLTWDQWEAFISKLRDDPSQSSELLSEAKKLNDSQAPK | 1176 |
| Z12788 | VDAKYAKEADIAAVEIAGLPNLTWDQWEAFIDKLRDDPSQSSELLSEAKKLNDSQAPK | 1177 |
| Z12790 | VDAKYAKEADTAALEIASLPNLTWDQWEAFIHKLRDDPSQSSELLSEAKKLNDSQAPK | 1178 |
| Z12791 | VDAKYAKEADAAAFEIAALPNLTWFQWFAFIAKLRDDPSQSSELLSEAKKLNDSQAPK | 1179 |
| Z12792 | VDAKYAKEADHAAMEIAMLPNLTWDQWFAFIAKLRDDPSQSSELLSEAKKLNDSQAPK | 1180 |
| Z12793 | VDAKYAKEADRAAFEIAELPNLTWDQWEAFIGKLRDDPSQSSELLSEAKKLNDSQAPK | 1181 |
| Z12794 | VDAKYAKEADSAAMEIADLPNLTWDQWLAFIDKLRDDPSQSSELLSEAKKLNDSQAPK | 1182 |
| Z12795 | VDAKYAKEADTAAVEIAALPNLTWDQWQAFILKLRDDPSQSSELLSEAKKLNDSQAPK | 1183 |
| Z12797 | VDAKYAKEADNAAYEIALLPNLTWDQWFAFIQKLRDDPSQSSELLSEAKKLNDSQAPK | 1184 |
| Z12798 | VDAKYAKEADAAAFEIAELPNLTWLQWHAFINKLRDDPSQSSELLSEAKKLNDSQAPK | 1185 |
| Z12799 | VDAKYAKEADSAALEIAGLPNLTWVQWWAFIGKLRDDPSQSSELLSEAKKLNDSQAPK | 1186 |
| Z12800 | VDAKYAKEADWAAVEIANLPNLTWDQWDAFIDKLRDDPSQSSELLSEAKKLNDSQAPK | 1187 |
| Z12801 | VDAKYAKEADKAALEIAQLPNLTWDQWWAFINKLRDDPSQSSELLSEAKKLNDSQAPK | 1188 |

FIG. 1PP

| | | |
|---|---|---|
| Z12802 | VDAKYAKEADMAAVEIAALLPNLTWDQWWAFISKLRDDPSQSSELLSEAKKLNDSQAPK | 1189 |
| Z12803 | VDAKYAKEADVAAVEIALLPNLTWDQWEAFINKLRDDPSQSSELLSEAKKLNDSQAPK | 1190 |
| Z12804 | VDAKYAKEADNAAFEIAFLPNLTWDQWWAFISKLRDDPSQSSELLSEAKKLNDSQAPK | 1191 |
| Z12805 | VDAKYAKEADAAAMEIAVLPNLTWDQWWAFIDKLRDDPSQSSELLSEAKKLNDSQAPK | 1192 |
| Z12807 | VDAKYAKEADIAAFEIAALPNLTWEQWWAFIWKLRDDPSQSSELLSEAKKLNDSQAPK | 1193 |
| Z12808 | VDAKYAKEADRAAVEIALLPNLTWDQWHAFIQKLRDDPSQSSELLSEAKKLNDSQAPK | 1194 |
| Z12809 | VDAKYAKEADAAAYEIAYLPNLTWIQWDAFIHKLRDDPSQSSELLSEAKKLNDSQAPK | 1195 |
| Z12810 | VDAKYAKEADNAAIEIAELPNLTWDQWAAFIMKLRDDPSQSSELLSEAKKLNDSQAPK | 1196 |
| Z12813 | VDAKYAKEADGAAMEIAGLPNLTWDQWFAFIMKLRDDPSQSSELLSEAKKLNDSQAPK | 1197 |
| Z12814 | VDAKYAKEADWAAMEIALLPNLTWDQWEAFIWKLRDDPSQSSELLSEAKKLNDSQAPK | 1198 |
| Z12815 | VDAKYAKEADNAAMEIAALPNLTWEQWDAFIRKLRDDPSQSSELLSEAKKLNDSQAPK | 1199 |
| Z06260 | VDAKYAKEHDYAWFEIALPNLTWDQATAFIRKLNDDPSQSSELLSEAKKLNDSQAPK | 1200 |
| Z06267 | VDAKYAKEMNRAQIEIWLLPNLTWHQQHAFIQKLIDDPSQSSELLSEAKKLNDSQAPK | 1201 |
| Z06270 | VDAKYAKEADDAWWEIWALPNLTHAQGKAFIVKLLDDPSQSSELLSEAKKLNDSQAPK | 1202 |
| Z06271 | VDAKYAKEAGDAQLEIWFLPNLTWAQSNAFIRKLIDDPSQSSELLSEAKKLNDSQAPK | 1203 |
| Z06274 | VDAKYAKEGDQAAMEIAELPNLTWDQWFEAFIHKLRDDPSQSSELLSEAKKLNDSQAPK | 1204 |
| Z06278 | VDAKYAKEADDAAVEIAALPNLTYDQWRAFIAKLRDDPSQSSELLSEAKKLNDSQAPK | 1205 |
| Z06282 | VDAKYAKEADQAAMEIATLPNLTWDQWFAFIAKLRDDPSQSSELLSEAKKLNDSQAPK | 1206 |
| Z06290 | VDAKYAKEADNAALEIADLPNLTWVQWNAFIQKLRDDPSQSSELLSEAKKLNDSQAPK | 1207 |
| Z06291 | VDAKYAKEADDAAFEIAALPNLTARQWYAFISKLRDDPSQSSELLSEAKKLNDSQAPK | 1208 |
| Z06447 | VDAKYAKETTYAWFEIWSLPNLTWDQQIAFIQKLNDDPSQSSELLSEAKKLNDSQAPK | 1209 |
| Z06448 | VDAKYAKEADYAWFEIWSLPNLTYTQQSAFIRKLNDDPSQSSELLSEAKKLNDSQAPK | 1210 |
| Z06449 | VDAKYAKEYDFAWFEIWLLPNLTRDQQSAFIHKLNDDPSQSSELLSEAKKLNDSQAPK | 1211 |
| Z06451 | VDAKYAKEADEAWFEIWLLPNLTRSQASAFITKLNDDPSQSSELLSEAKKLNDSQAPK | 1212 |
| Z06453 | VDAKYAKEADFAWFEIWALPNLTHDQSVAFIRKLNDDPSQSSELLSEAKKLNDSQAPK | 1213 |
| Z06455 | VDAKYAKEMDNAQWEIWLLPNLTWAQQHAFIGKLIDDPSQSSELLSEAKKLNDSQAPK | 1214 |
| Z06461 | VDAKYAKEMDDAWWEIWDLPNLTYYQQRAFIVKLVDDPSQSSELLSEAKKLNDSQAPK | 1215 |
| Z06462 | VDAKYAKEWGEAQLEIWLLPNLTWQGHAFIQKLLDDPSQSSELLSEAKKLNDSQAPK | 1216 |
| Z10199 | AEAKYAKEADQAAMEIATLPNLTWDQWFAFIAKLRDDPSQSSELLSEAKKLNDSQAPKVD | 1217 |

FIG. 1QQ

| | | |
|---|---|---|
| Z12876 | AEAKYAKEADDAAVEIADLPNLTWDQWYAFISKLRDDPSQSSELLSEAKKLNDSQAPK | 1218 |
| Z14253 | AEAKYAKEADDAAVEIASLPNLTWDQWYAFIQKLRDDPSQSSELLSEAKKLNDSQAPK | 1219 |
| Z14254 | AEAKYAKEADDAAVEIAALPNLTWDQWFAFISKLRDDPSQSSELLSEAKKLNDSQAPK | 1220 |
| Z14255 | AEAKYAKEADQAAVEIADLPNLTWAQWYAFIQKLRDDPSQSSELLSEAKKLNDSQAPK | 1221 |
| Z15166 | AEAKYAKEADDAAVEIASLPNLTWAQWYAFIQKLRDDPSQSSELLSEAKKLNDSQAPK | 1222 |
| Z04726 | VDAKYAKELGWATWEIFNLPNLTGVQVKAFIDKLRDDPSQSSELLSEAKKLNDSQAPK | 1223 |
| PP013 | LAEAKEAANAELDSYGVSDFYKRLIDKAKTVEGVEALKDAILAALP | 1224 |
| PEP07843 | GSSLAEAKEAANAELDSYGVSDFYKRLIDKAKTVEGVEALKDAILAALP | 1225 |
| hIL-17A | MIVKAGITIPRNPGCPNSEDKNFPRTVMVNLNIHNRNTNTNPKRSSDYYNRSTSPWNLHRNEDPERYP SVIWEAKCRHLGCINADGNVDYHMNSVPIQQEILVLRREPPHCPNSFRLEKILVSVGCTCVTPIVHHV A | 1226 |
| mIL-17A | AAIIPQSSACPNTEAKDFLQNVKVNLKVFNSLGAKVSSRRPSDYLNRSTSPWTLHRNEDPDRYPSVIW EAQCRHQRCVNAEGKLDHHMNSVLIQQEILVLKREPESCPFTFRVEKMLVGVGCTCVASIVRQAA | 1227 |
| hIL-17F | MRKIPKVGHTFFQKPESCPPVPGGSMKLDIGIINENQRVSMSRNIESRSTSPWNYTVTWDPNRYPSEV VQAQCRNLGCINAQGKEDISMNSVPIQQETLVVRRKHQGCSVSFQLEKVLVTVGCTCVTPIVHHVQ | 1228 |
| cIL-17A | MTPGKTSLVLLLLLSLEAIVKAGIAIPRNSGCPNSEDKNFPRTVMVNLNIHNRNTSTNPKRSSDYYN RSTSPWNLHRNEDPERYPSVIWEAKCRHLGCVKADGNVDYHMNSVPIQQEILVLRREPRHCPNSFRLE KILVSVGCTCVTPIVHHVA | 1229 |
| rmIL-17A | GIAIPRNPGCPNSEDKTFPRTVMVNLNIHNRNTNTNPKRSSDYYNRSTSPWNLHRNEDPERYPSVIWE AKCRHLGCVNADGNVDYHMNSVPIQQEILVLRREPRHCPNSFRLEKILVSVGCTCVTPIVHHVA | 1230 |

Figure 2
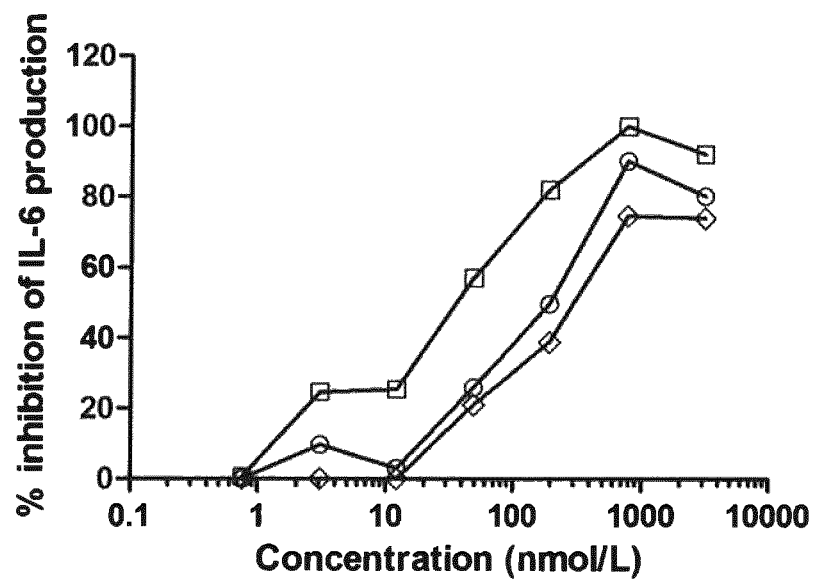
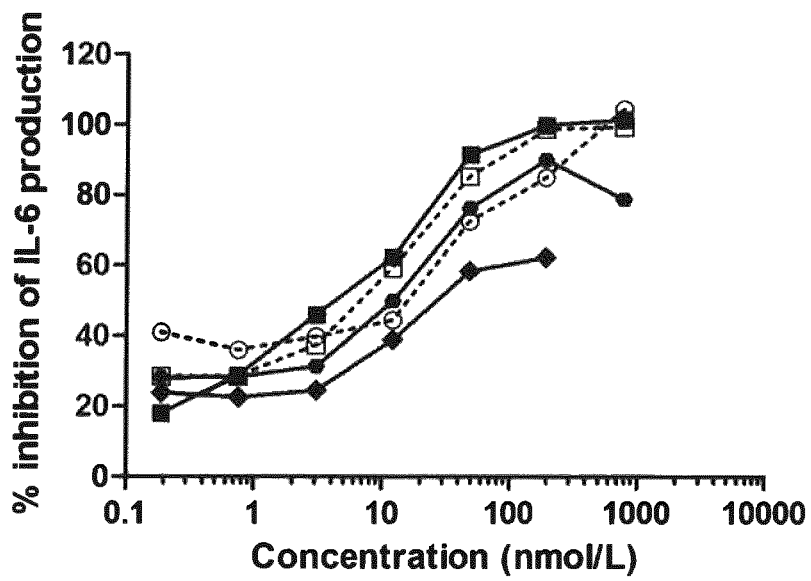

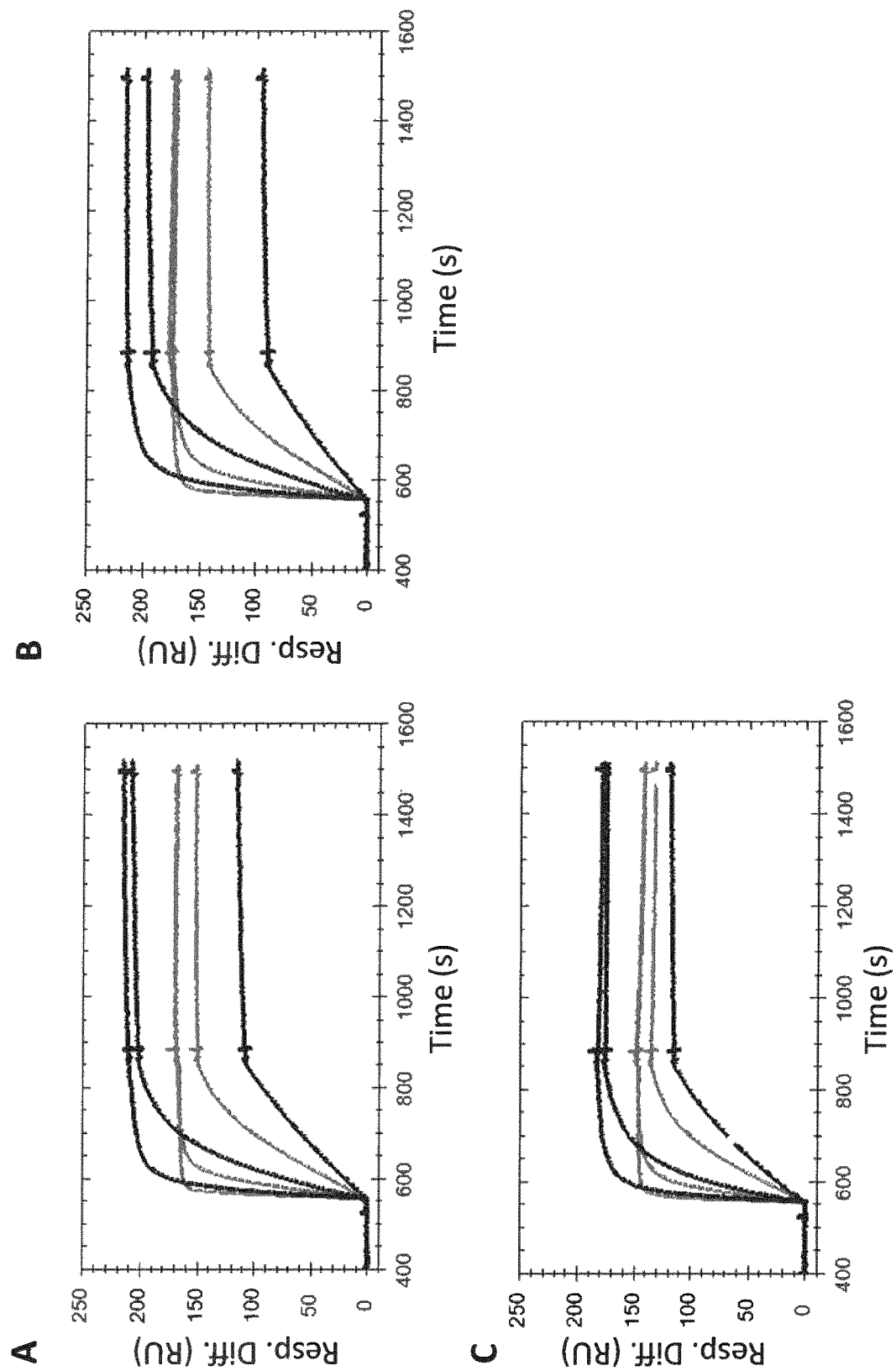
Figure 6A-C

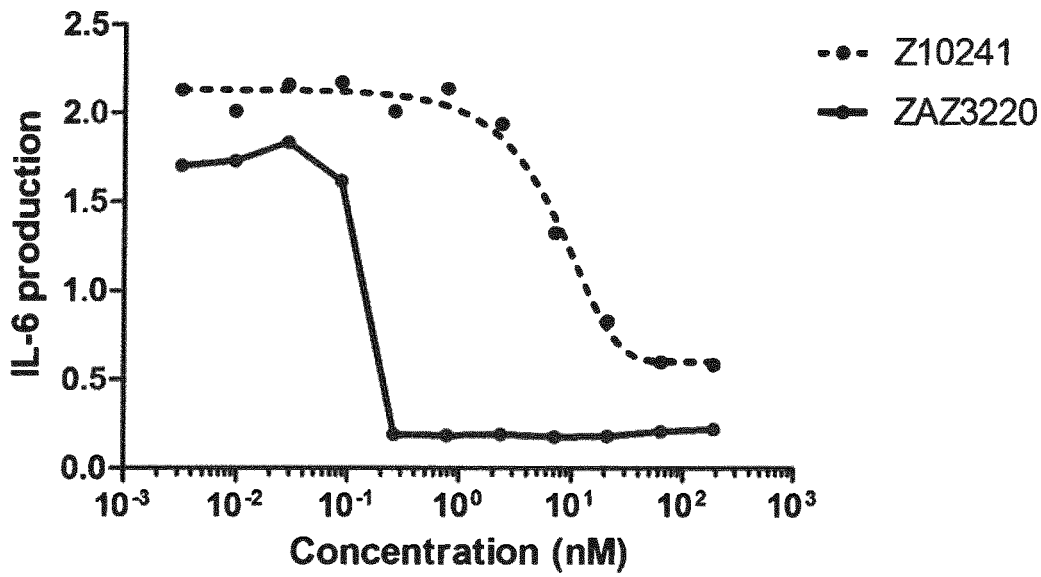
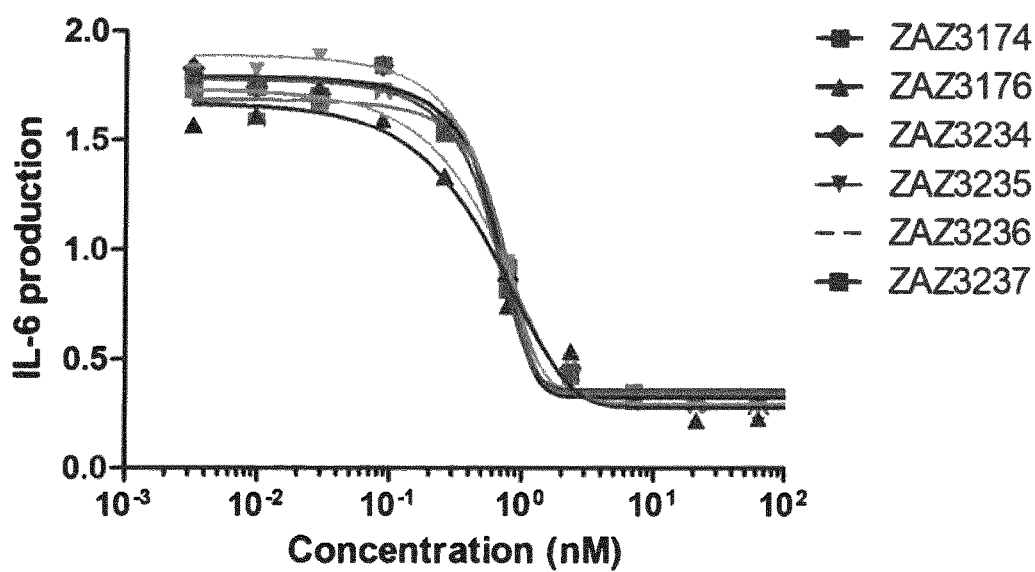
Figure 7A-B

Figure 9A-B
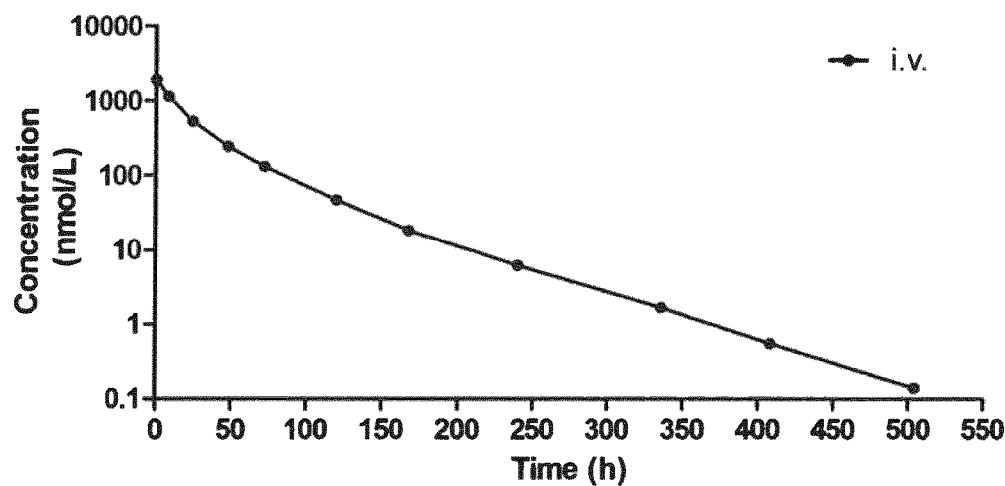
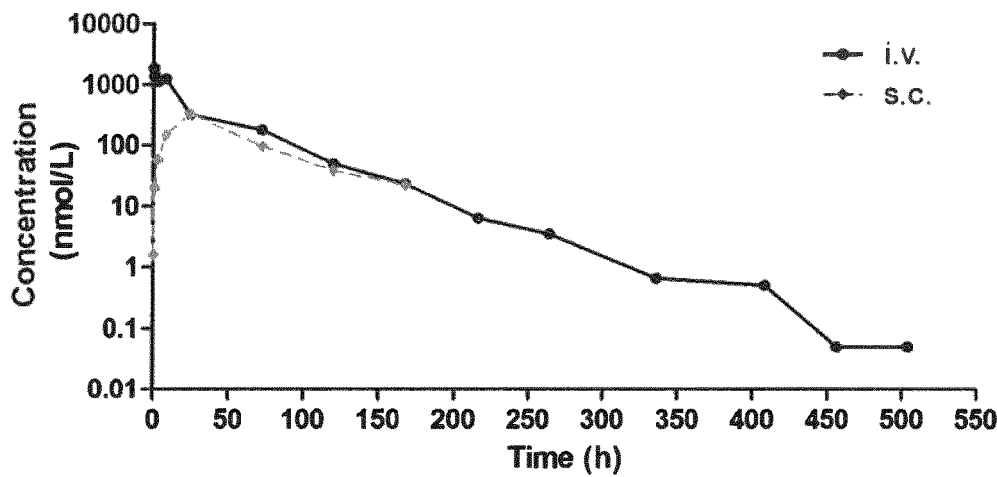

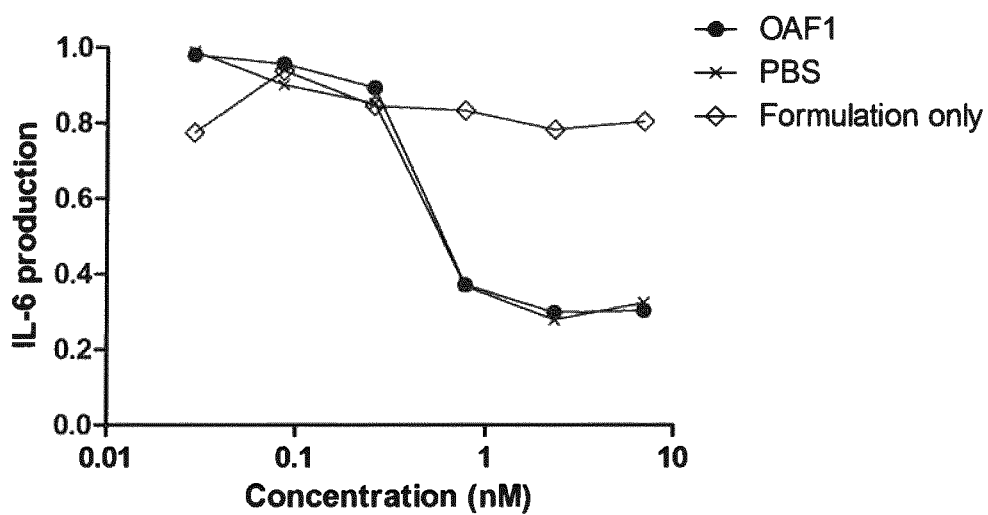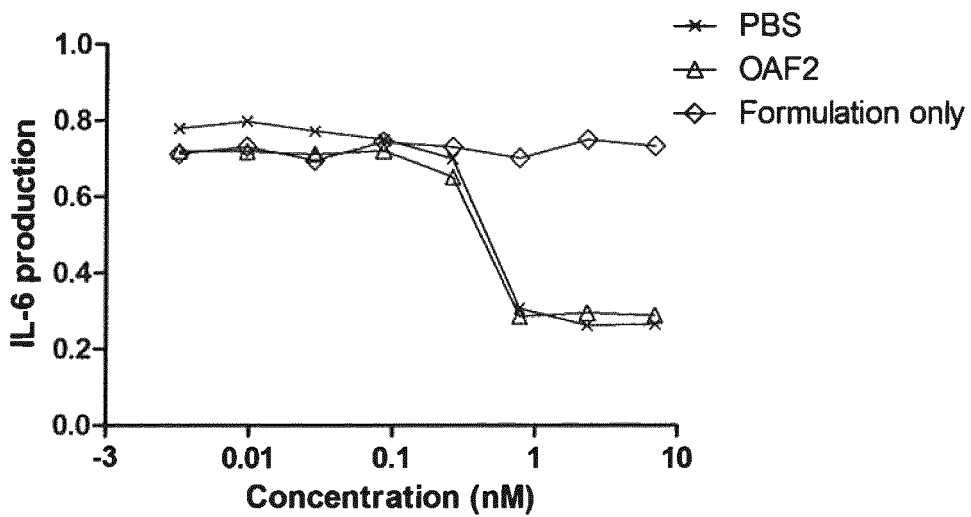
Figure 11A-B

Figure 13A-B
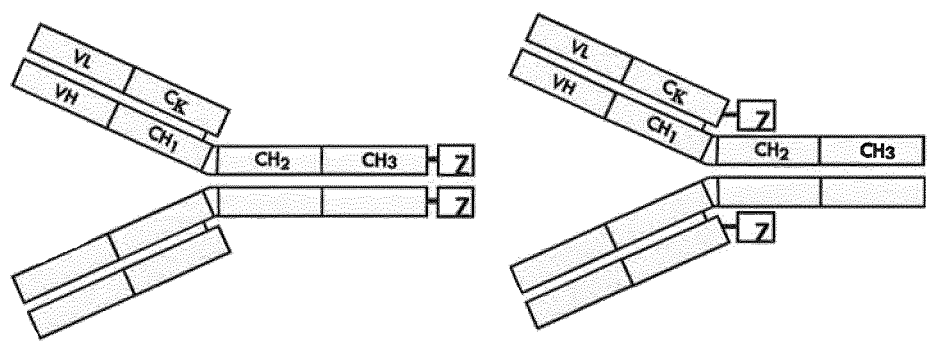
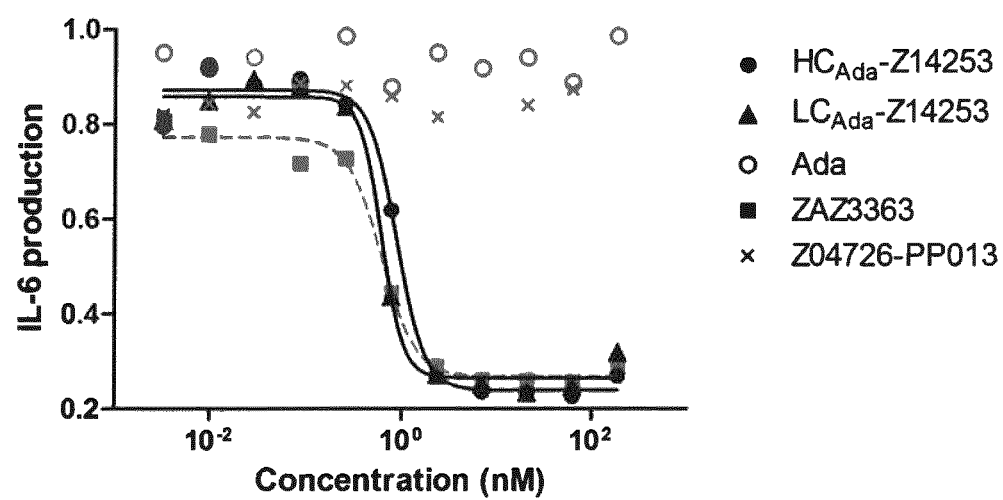

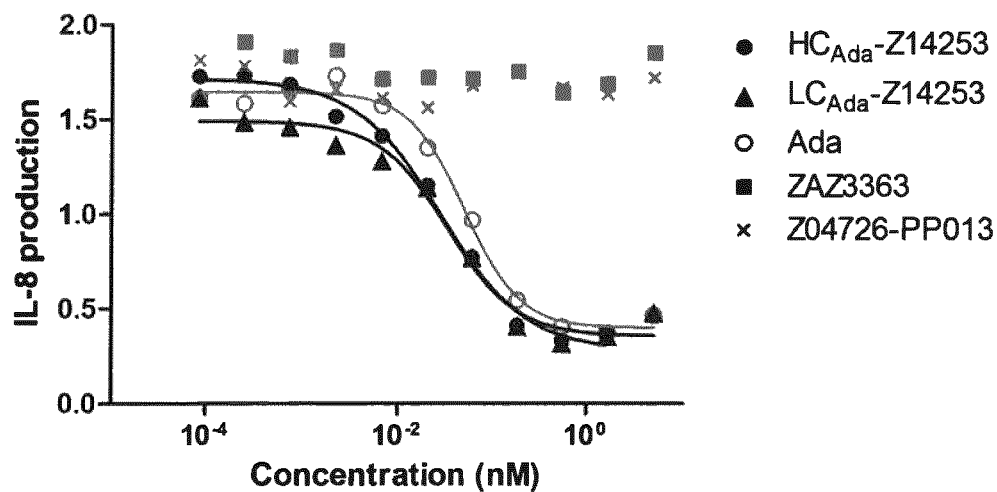
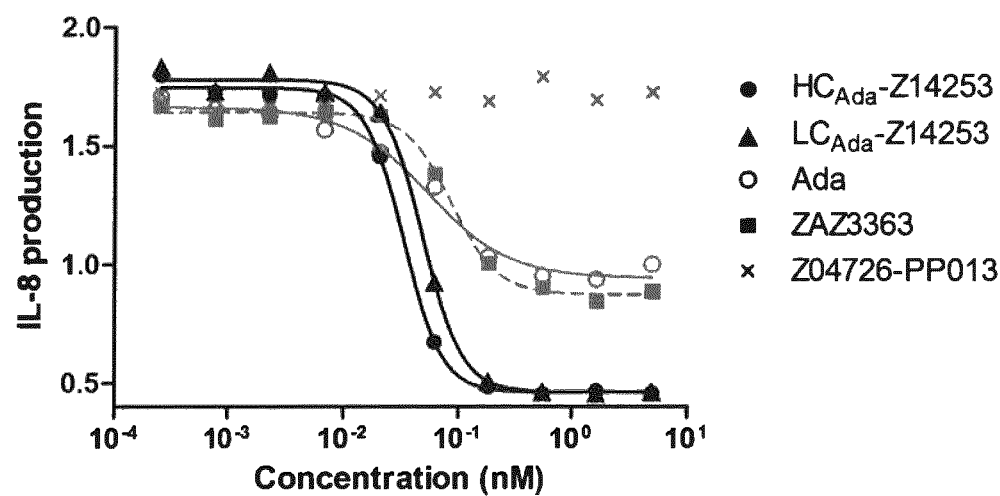
Figure 13C-D

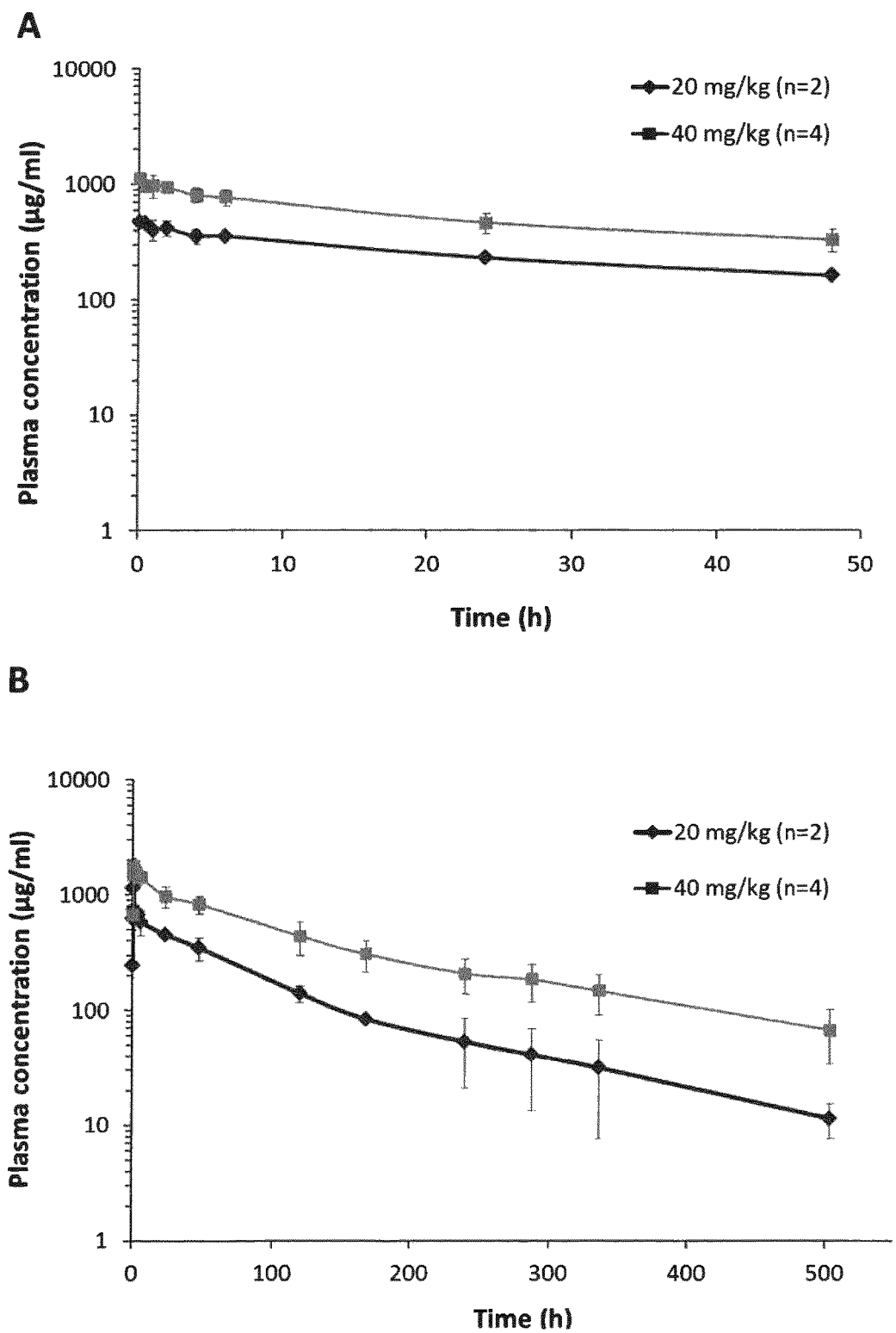
Figure 14A-B

IL-17A-BINDING POLYPEPTIDES

FIELD OF THE INVENTION

The present disclosure relates to a class of engineered polypeptides having a binding affinity for interleukin-17A (in the following referred to as IL-17A). The present disclosure also relates to the use of such an interleukin-17A binding polypeptide as a diagnostic, prognostic and/or therapeutic agent.

BACKGROUND

The interleukin-17 (IL-17) family is a pro-inflammatory cytokine family that contributes to the pathogenesis of several inflammatory diseases. A major source of IL-17 is a lineage of T cells known as T helper 17 cells (Th17 cells), which are distinct from the classical Th1 and Th2 cell subsets. Results of studies in mouse models and in humans have identified a key role of IL-17 and Th17 cells in the pathogenesis of inflammation and autoimmunity as well as in host defense against certain pathogens. Based on these observations, IL-17 and Th17 cells are considered to be interesting targets for the treatment of several chronic inflammatory diseases such as psoriasis, rheumatoid arthritis (RA), ankylosing spondylitis (AS), systemic lupus erythematosus (SLE) and multiple sclerosis (MS) (Miossec and Kolls, 2012, Nat Rev Drug Discov 11:763-7).

The disulfide-linked homodimeric cytokine IL-17A is a member of the IL-17 family, which also includes IL-17B, IL-17C, IL-17D, IL-17E and IL-17F. Within the family, IL-17A and IL-17F show the highest amino acid sequence homology to each other (50%) and they bind to the same receptors: IL-17 receptor A (IL-17RA) and IL-17 receptor C (IL-17RC). Furthermore, IL-17A can be expressed with IL-17F as a heterodimer. Although IL-17A and IL-17F share high amino acid sequence homology, they perform distinct functions. IL-17A is involved in the development of autoimmunity, inflammation and tumors and also plays important roles in the host defense against bacterial and fungal infections. IL-17F, on the other hand, is mainly involved in mucosal host defense mechanisms (Iwakura et al, 2011, Immunity 34:149-62).

When IL-17A is secreted, it promotes the production of a variety of proinflammatory cytokines, chemokines, antimicrobial peptides and metalloproteinases (MMPs) from fibroblast, endothelial and epithelial cells. One important action of IL-17A is to induce granulopoiesis and neutrophil recruitment to inflammatory sites. However, if uncontrolled, this reaction may lead to chronic inflammation with tissue destruction and neovascularization (Iwakura et al. 2008, Immunol Rev 226:57-79; Reynolds et al. 2010, Cytokine Growth Factor Rev 21:413-23). IL-17A is central in the pathogenesis of psoriasis, a common chronic inflammatory skin disease affecting about 2.5% of the worldwide population (reviewed in Chiricozzi and Krueger, 2013, Expert Opin. Investig. Drugs 22(8):993-1005). Studies in patients with RA have shown that IL-17A positive cells are present in the inflamed synovium. In a mouse model of RA, the clinical scores were severely aggravated by administration of IL-17A via intra-articular gene transfer (Lubberts et al. 2002, Inflamm Res 51:102-4). Conversely, inhibition of IL-17A with monoclonal antibodies against the ligand or the receptor protected against development and consequences of arthritis (Lubberts et al. 2004, Arthritis Rheum 50:650-9). In MS patients, the IL-17A gene is reported to be overexpressed (Lock et al. 2002, Nat Med 8:500-8) and IL-17A and Th17 cells have been clearly implicated in the mouse model of experimental autoimmune encephalitis (Cua et al. 2003, Nature 421:744-8; Uyttenhove and Van Snick 2006, Eur J Immunol 36:2868-74). Increased levels of IL-17A have been shown to be clinically correlated with various ocular inflammatory diseases, such as uveitis, scleritis and dry eye disease (DED) in patients suffering from arthritis (Kang et al. 2011, J Korean Med Sci 26:938-44). Recent studies have showed IL-17 and IFNγ positive cells in clinical specimens of coronary atherosclerosis suggesting a local effect on vessel dysfunction (Eid et al. 2009, J Cardiothorac Surg 4:58). IL-17A may also be of interest in chronic obstructive pulmonary disease (COPD). The number of IL-17A positive cells is increased in lung tissues from COPD patients (Chu et al. 2011, Int Immunopharmacol 11:1780-8; Di Stefano et al. 2009, Clin Exp Immunol 157:316-24). IL-17RA deficient mice are resistant to the development of emphysema in a mouse model of COPD whereas overexpression of IL-17A accelerates the development of emphysema suggesting that IL-17A is sufficient to mediate this response (Chen et al. 2011, PLoS One 6:e20333; Shan et al. 2012, Sci Transl Med 4:117ra9). Thus, the involvement of IL-17A in several different autoimmune and inflammatory diseases suggests a wide applicability of therapeutics targeting IL-17A.

Targeting of IL-17A or its receptors is the most direct way to block IL-17A-mediated functions. Several biologics that neutralize IL-17A signaling are now in clinical development, including the anti-IL-17A monoclonal antibodies secukinumab and ixekizumab (Patel et al, 2013, Ann Rheum Dis 72 Suppl 2:ii116-23). Secukinumab has been approved for the treatment of psoriasis and is currently investigated for the treatment of psoriatic arthritis (PsA) and AS. Ixekizumab is currently in clinical trials for psoriasis, PsA and RA. Blocking of IL-17 receptor mediated signaling is also under investigation in the clinic, including the human monoclonal anti-IL-17RA antibody brodalumab for treatment of psoriasis, RA and asthma (Hu et al. 2011, Ann N Y Acad Sci 1217:60-76). Thus, clinical efficacy of IL-17A-inhibition has been proven in different diseases, notably in psoriasis, and the safety profile, including phase II and phase III data, shows good tolerability for IL-17A inhibitors (Genovese et al. 2010, Arthritis Rheum 62:929-39 and Hueber et al. 2010, Sci Transl Med 2:52ra72).

The unpredictable and chronic nature of psoriasis and other inflammatory diseases, as well as a high unmet medical need, warrants the development of new modes of treatment.

Since tissue penetration rate is negatively associated with the size of the molecule, a relatively large antibody molecule inherently has poor tissue distribution and penetration capacity. Moreover, although antibodies are widely used in a variety of routine contexts owing to high affinity and specificity to a multitude of possible antigens, such as for analytical, purification, diagnostic and therapeutic purposes, they still suffer from several drawbacks. Such drawbacks include the need for complex mammalian expression systems, aggregation tendencies, limited solubility, need to form and stably maintain disulfide bonds, and the risk of unwanted immune responses.

Thus, the use of monoclonal antibodies is not always optimal for therapy, and there is continued need for provision of agents with a high affinity for IL-17A. Of great interest is also the provision of uses of such molecules in the treatment, diagnosis and prognosis of disease.

SUMMARY OF THE INVENTION

It is an object of the present disclosure to provide new IL-17A binding agents, which could for example be used for diagnostic, prognostic and therapeutic applications.

It is an object of the present disclosure to provide new IL-17A binding agents, which may be used as domains in fusion proteins comprising one or more additional domains having similar or other functions.

It is an object of the present disclosure to provide a molecule allowing for efficient therapy targeting various forms of inflammatory and autoimmune disease while alleviating the abovementioned and other drawbacks of current therapies.

It is a further object of the present disclosure to provide a molecule suitable for prognostic and diagnostic applications.

These and other objects which are evident to the skilled person from the present disclosure are met by different aspects of the invention as claimed in the appended claims and as generally disclosed herein.

Thus, in the first aspect of the disclosure, there is provided an IL-17A binding polypeptide, comprising an IL-17A binding motif BM, which motif consists of an amino acid sequence selected from:

i) $EX_2DX_4AX_6X_7E_1X_{10}X_{11}LPNL\ X_{16}X_{17}X_{18}QX_{20}X_{21}AFIX_{25}\ X_{26}LX_{28}X_{29}$ (SEQ ID NO:1295)

wherein, independently from each other, $X_2$ is selected from A, H, M and Y;
$X_4$ is selected from A, D, E, F, K, L, M, N, Q, R, S and Y;
$X_6$ is selected from A, Q and W;
$X_7$ is selected from F, I, L, M, V, W and Y;
$X_{10}$ is selected from A and W;
$X_{11}$ is selected from A, D, E, F, G, L, M, N, Q, S, T and Y;
$X_{16}$ is selected from N and T;
$X_{17}$ is selected from H, W and Y;
$X_{18}$ is selected from A, D, E, H and V;
$X_{20}$ is selected from A, G, Q, S and W;
$X_{21}$ is selected from A, D, E, F, H, K, N, R, T, V, W and Y;
$X_{25}$ is selected from A, D, E, G, H, I, L, M, N, Q, R, S, T and V;
$X_{26}$ is selected from K and S;
$X_{28}$ is selected from I, L, N and R; and
$X_{29}$ is selected from D and R;
and
ii) an amino acid sequence which has at least 89% identity to the sequence defined in i).

The above definition of a class of sequence related, IL-17A binding polypeptides is based on a statistical analysis of a number of random polypeptide variants of a parent scaffold, that were selected for their interaction with IL-17A in several different selection experiments. The identified IL-17A binding motif, or "BM", corresponds to the target binding region of the parent scaffold, which region constitutes two alpha helices within a three-helical bundle protein domain. In the parent scaffold, the varied amino acid residues of the two BM helices constitute a binding surface for interaction with the constant Fc part of antibodies. In the present disclosure, the random variation of binding surface residues and subsequent selection of variants have replaced the Fc interaction capacity with a capacity for interaction with IL-17A.

As the skilled person will realize, the function of any polypeptide, such as the IL-17A binding capacity of the polypeptide of the present disclosure, is dependent on the tertiary structure of the polypeptide. It is therefore possible to make minor changes to the sequence of amino acids in a polypeptide without affecting the function thereof. Thus, the disclosure encompasses modified variants of the IL-17A binding polypeptide, which are such that the IL-17A binding characteristics are retained.

In this way, also encompassed by the present disclosure is an IL-17A binding polypeptide comprising an amino acid sequence with 89% or greater identity to a polypeptide as defined in i). In some embodiments, the polypeptide may comprise a sequence which is at least 93%, such as at least 96% identical to a polypeptide as defined in i). For example, it is possible that an amino acid residue belonging to a certain functional grouping of amino acid residues (e.g. hydrophobic, hydrophilic, polar etc) could be exchanged for another amino acid residue from the same functional group.

In some embodiments, such changes may be made in any position of the sequence of the IL-17A binding polypeptide as disclosed herein. In other embodiments, such changes may be made only in the non-variable positions, also denoted scaffold amino acid residues. In such cases, changes are not allowed in the variable positions, i.e. positions denoted with an "X" in sequence i).

The term "% identity", as used throughout the specification, may for example be calculated as follows. The query sequence is aligned to the target sequence using the CLUSTAL W algorithm (Thompson et al, Nucleic Acids Research, 22: 4673-4680 (1994)). A comparison is made over the window corresponding to the shortest of the aligned sequences. The shortest of the aligned sequences may in some instances be the target sequence. In other instances, the query sequence may constitute the shortest of the aligned sequences. The amino acid residues at each position are compared and the percentage of positions in the query sequence that have identical correspondences in the target sequence is reported as % identity.

In one particular embodiment according to the first aspect, there is provided a polypeptide as defined above, wherein, in sequence i), $X_2$ is selected from A, H and M;
$X_4$ is selected from A, D, E, F, L, M, N, Q, R and Y;
$X_{11}$ is selected from A, D, E, F, G, L, M, N, S, T and Y;
$X_{18}$ is selected from A, D, E and V;
$X_{20}$ is selected from A, G, Q and W;
$X_{21}$ is selected from E, F, H, N, R, T, V, W and Y;
$X_{25}$ is selected from A, D, E, G, H, I, L, N, Q, R, S, T and V; and
$X_{28}$ is selected from I, N and R.

In another particular embodiment according to the first aspect, there is provided a polypeptide as defined in the paragraph immediately above, wherein in addition, in sequence i), $X_{16}$ is T;
$X_{17}$ is W;
$X_{21}$ is selected from E, F, H, W, T and Y;
$X_{25}$ is selected from A, D, E, G, H, I, L, N, Q, R, S and T;
$X_{26}$ is K; and
$X_{29}$ is D.

"$X_n$" and "$X_m$" are used herein to indicate amino acids in positions n and m in the sequence i) as defined above, wherein n and m are integers indicating the position of an amino acid within sequence i) as counted from the N terminus. For example, $X_3$ and $X_7$ indicate the amino acids in positions three and seven, respectively, from the N-terminal end of sequence i).

In embodiments according to the first aspect, there are provided polypeptides wherein $X_n$ in sequence i) is independently selected from a group of possible residues as listed in Table 1. The skilled person will appreciate that $X_n$ may be selected from any one of the listed groups of possible residues and that this selection is independent from the selection of amino acids in $X_m$, wherein n≠m. Thus, any of the listed possible residues in position $X_n$ in Table 1 may be independently combined with any of the listed possible residues any other variable position in Table 1.

The skilled person will appreciate that Table 1 is to be read as follows: In one embodiment according to the first aspect, there is provided a polypeptide wherein amino acid residue "$X_n$" in sequence i) is selected from "Possible residues". Thus, Table 1 discloses several specific and individualized embodiments of the first aspect of the present disclosure. For example, in one embodiment according to the first aspect, there is provided a polypeptide wherein $X_4$ in sequence i) is selected from A, D, E, F, L, N, Q, R and Y, and in another embodiment according to the first aspect, there is provided a polypeptide wherein $X_4$ in sequence i) is selected from D, E, N and Y. For avoidance of doubt, the listed embodiments may be freely combined in yet other embodiments. For example, one such combined embodiment is a polypeptide in which $X_4$ is selected from D, E, F, N, Q, R and Y, while $X_7$ is selected from F, V and W, and $X_{18}$ is selected from A, D, E and H, and so on.

TABLE 1

| $X_n$ | Possible residues |
|---|---|
| $X_2$ | A, M, Y |
| $X_2$ | A, M |
| $X_2$ | A |
| $X_4$ | A, D, E, F, K, L, M, N, Q, R, Y |
| $X_4$ | A, D, E, F, L, M, N, Q, R, S, Y |
| $X_4$ | A, D, E, F, L, M, N, Q, R, Y |
| $X_4$ | A, D, E, F, L, N, Q, R, Y |
| $X_4$ | A, D, E, F, M, N, Q, Y |
| $X_4$ | A, D, E, F, L, Q, R |
| $X_4$ | A, D, E, L, Q, R |
| $X_4$ | A, D, Q, R |
| $X_4$ | D, Q |
| $X_4$ | A, D, E, F, N, Q, Y |
| $X_4$ | D, E, F, N, Q, R, Y |
| $X_4$ | D, E, N, Q, Y |
| $X_4$ | D, E, N, Y |
| $X_4$ | D, E, Q, Y |
| $X_4$ | D, E, Y |
| $X_4$ | D, E |
| $X_4$ | D |
| $X_4$ | Q |
| $X_6$ | A, Q |
| $X_6$ | A, W |
| $X_6$ | Q, W |
| $X_6$ | W |
| $X_6$ | A |
| $X_6$ | Q |
| $X_7$ | F, I, L, V, W, Y |
| $X_7$ | F, I, L, V, Y |
| $X_7$ | I, L, V, Y |
| $X_7$ | L, V, Y |
| $X_7$ | L, V |
| $X_7$ | F, M, V, W, Y |
| $X_7$ | F, V, W, Y |
| $X_7$ | F, V, W |
| $X_7$ | F, V |
| $X_7$ | V |
| $X_7$ | L |
| $X_7$ | Y |
| $X_{10}$ | A |
| $X_{10}$ | W |
| $X_{11}$ | A, D, E, F, G, L, M, N, S, T, Y |
| $X_{11}$ | A, D, E, F, L, M, S, T |
| $X_{11}$ | A, D, E, F, G, L, M, N, S, Y |
| $X_{11}$ | A, D, E, F, G, S, Y |
| $X_{11}$ | A, D, E, F, L, M, S |
| $X_{11}$ | A, D, E, L, M, S |
| $X_{11}$ | A, D, E, L, S |

TABLE 1-continued

| $X_n$ | Possible residues |
|---|---|
| $X_{11}$ | A, D, E, L, M |
| $X_{11}$ | A, D, E, L |
| $X_{11}$ | D, E, L |
| $X_{11}$ | D, L |
| $X_{11}$ | A, D, E, F, S, Y |
| $X_{11}$ | A, D, E, S |
| $X_{11}$ | A, D, S |
| $X_{11}$ | A, S |
| $X_{11}$ | A, D |
| $X_{11}$ | D, S |
| $X_{11}$ | L |
| $X_{11}$ | D |
| $X_{11}$ | S |
| $X_{11}$ | A |
| $X_{11}$ | E |
| $X_{16}$ | T |
| $X_{16}$ | N |
| $X_{17}$ | H, W |
| $X_{17}$ | Y, W |
| $X_{17}$ | H, Y |
| $X_{17}$ | W |
| $X_{17}$ | H |
| $X_{17}$ | Y |
| $X_{18}$ | A, D, E, V |
| $X_{18}$ | A, D, E, H |
| $X_{18}$ | A, D, H |
| $X_{18}$ | A, D, E |
| $X_{18}$ | A, D |
| $X_{18}$ | D, E |
| $X_{18}$ | D |
| $X_{18}$ | A |
| $X_{20}$ | A, G, Q, W |
| $X_{20}$ | A, Q, S, W |
| $X_{20}$ | A, Q, W |
| $X_{20}$ | G, Q, W |
| $X_{20}$ | G, W |
| $X_{20}$ | Q, W |
| $X_{20}$ | A, W |
| $X_{20}$ | W |
| $X_{20}$ | A |
| $X_{20}$ | Q |
| $X_{21}$ | A, D, E, F, H, N, R, T, V, W, Y |
| $X_{21}$ | A, D, E, F, H, N, R, V, W, Y |
| $X_{21}$ | E, F, H, N, R, V, W, Y |
| $X_{21}$ | F, H, N, R, V, W, Y |
| $X_{21}$ | E, F, H, T, W, Y |
| $X_{21}$ | E, F, H, W, Y |
| $X_{21}$ | F, H, R, W, Y |
| $X_{21}$ | F, H, W, Y |
| $X_{21}$ | F, W, Y |
| $X_{21}$ | W, Y |
| $X_{21}$ | F, Y |
| $X_{21}$ | F, W |
| $X_{21}$ | Y |
| $X_{21}$ | W |
| $X_{21}$ | F |
| $X_{25}$ | A, D, E, G, H, I, L, N, Q, R, S, T, V |
| $X_{25}$ | A, D, E, G, H, I, L, N, Q, R, S, T |
| $X_{25}$ | A, D, E, G, H, N, Q, R, S, T, V |
| $X_{25}$ | D, E, G, N, Q, R, S, T, V |
| $X_{25}$ | D, E, N, Q, R, V |
| $X_{25}$ | A, D, E, G, I, L, N, Q, R, S, T |
| $X_{25}$ | D, E, G, N, Q, R, S |
| $X_{25}$ | D, E, N, Q, R, S |
| $X_{25}$ | A, E, G, L, N, Q, R, S |
| $X_{25}$ | E, N, Q, R, S |
| $X_{25}$ | E, N, Q, S, T |
| $X_{25}$ | E, N, Q, S |
| $X_{25}$ | N, Q, R |
| $X_{25}$ | E, Q, R |
| $X_{25}$ | Q, R, S |
| $X_{25}$ | Q, S |
| $X_{25}$ | Q, R |
| $X_{25}$ | Q |
| $X_{25}$ | S |
| $X_{25}$ | N |
| $X_{25}$ | E |
| $X_{26}$ | K |

TABLE 1-continued

| $X_n$ | Possible residues |
|---|---|
| $X_{26}$ | S |
| $X_{28}$ | I, N, R |
| $X_{28}$ | I, L, R |
| $X_{28}$ | I, R |
| $X_{28}$ | N, R |
| $X_{28}$ | I, N |
| $X_{28}$ | R |
| $X_{28}$ | I |
| $X_{28}$ | N |
| $X_{29}$ | D |
| $X_{29}$ | R |

In a more specific embodiment defining a sub-class of IL-17A binding polypeptides, sequence i) fulfills at least six of the eleven conditions I-XI:

I. $X_2$ is A;
II. $X_4$ is selected from D, E and Q;
III. $X_6$ is A;
IV. $X_7$ is selected from F and V;
V. $X_{16}$ is T;
VI. $X_{17}$ is W;
VII. $X_{18}$ is selected from A and D;
VIII. $X_{20}$ is W;
IX. $X_{26}$ is K;
X. $X_{28}$ is R; and
XI. $X_{29}$ is D.

In some examples of an IL-17A binding polypeptide according to the first aspect, sequence i) fulfills at least seven of the eleven conditions I-XI. More specifically, sequence i) may fulfill at least eight of the eleven conditions I-XI, such as at least nine of the eleven conditions I-XI, such as at least ten of the eleven conditions I-XI, such as all of the eleven conditions I-XI.

In some embodiments of an IL-17A binding polypeptide according to the first aspect, $X_2X_6$, $X_2X_{10}$ or $X_6X_{10}$ is AA. In some embodiments, $X_2X_{17}$, $X_2X_{20}$, $X_6X_{17}$, $X_6X_{20}$, $X_{10}X_{17}$ or $X_{10}X_{20}$ is AW. In some embodiments, $X_2X_{28}$, $X_6X_{28}$ or $X_{10}X_{28}$ is AR. In some embodiments, $X_{17}X_{28}$ or $X_{20}X_{28}$ is WR. In some embodiments, $X_{17}X_{20}$ is WW.

As described in detail in the experimental section to follow, the selection of IL-17A binding polypeptide variants has led to the identification of a number of individual IL-17A binding motif (BM) sequences. These sequences constitute individual embodiments of sequence i) according to this aspect. The sequences of individual IL-17A binding motifs correspond to amino acid positions 8-36 in SEQ ID NO:1-1216 presented in FIG. 1. Hence, in one embodiment of the IL-17A binding polypeptide according to this aspect, sequence i) corresponds to the sequence from position 8 to position 36 in a sequence selected from the group consisting of SEQ ID NO:1-1216. In one embodiment, sequence i) corresponds to the sequence from position 8 to position 36 in a sequence selected from the group consisting of SEQ ID NO:1-66, 1200, 1206 and 1214. In one embodiment, sequence i) corresponds to the sequence from position 8 to position 36 in a sequence selected from the group consisting of SEQ ID NO:1-66. In one embodiment, sequence i) corresponds to the sequence from position 8 to position 36 in a sequence selected from the group consisting of SEQ ID NO:1-35. In one embodiment, sequence i) corresponds to the sequence from position 8 to position 36 in a sequence selected from the group consisting of SEQ ID NO:1-27. In one embodiment, sequence i) corresponds to the sequence from position 8 to position 36 in a sequence selected from the group consisting of SEQ ID NO:1-10. In one embodiment, sequence i) corresponds to the sequence from position 8 to position 36 in a sequence selected from the group consisting of SEQ ID NO:1-7. In one embodiment, sequence i) corresponds to the sequence from position 8 to position 36 in a sequence selected from the group consisting of SEQ ID NO:1-4. In one embodiment, sequence i) corresponds to the sequence from position 8 to position 36 in SEQ ID NO:1.

In some embodiments of the present disclosure, the BM as defined above "forms part of" a three-helix bundle protein domain. This is understood to mean that the sequence of the BM is "inserted" into or "grafted" onto the sequence of the original three-helix bundle domain, such that the BM replaces a similar structural motif in the original domain. For example, without wishing to be bound by theory, the BM is thought to constitute two of the three helices of a three-helix bundle, and can therefore replace such a two-helix motif within any three-helix bundle. As the skilled person will realize, the replacement of two helices of the three-helix bundle domain by the two BM helices has to be performed so as not to affect the basic structure of the polypeptide. That is, the overall folding of the Ca backbone of the polypeptide according to this embodiment of the invention is substantially the same as that of the three-helix bundle protein domain of which it forms a part, e.g. having the same elements of secondary structure in the same order etc. Thus, a BM according to the disclosure "forms part" of a three-helix bundle domain if the polypeptide according to this embodiment of the aspect has the same fold as the original domain, implying that the basic structural properties are shared, those properties e.g. resulting in similar CD spectra. The skilled person is aware of other parameters that are relevant.

In particular embodiments, the IL-17A binding motif (BM) thus forms part of a three-helix bundle protein domain. For example, the BM may essentially constitute two alpha helices with an interconnecting loop, within said three-helix bundle protein domain. In particular embodiments, said three-helix bundle protein domain is selected from domains of bacterial receptor proteins. Non-limiting examples of such domains are the five different three-helical domains of Protein A from *Staphylococcus aureus*, such as domain B, and derivatives thereof. In some embodiments, the three-helical bundle protein domain is a variant of protein Z, which is derived from domain B of staphylococcal Protein A.

In some embodiments where the IL-17A binding polypeptide as disclosed herein forms part of a three-helix bundle protein domain, the IL-17A binding polypeptide may comprise an amino acid sequence binding module (BMod) selected from:

iii) K-[BM]-1DPSQS $X_aX_bLLX_c$ EAKKL $X_dX_eX_fQ$ (SEQ ID NO:1296),
  wherein
  [BM] is an IL-17A binding motif as defined herein, provided that $X_{29}$ is
  $X_a$ is selected from A and
  $X_b$ is selected from N and E;
  $X_c$ is selected from A, S and C;
  $X_d$ is selected from E, N and S;
  $X_e$ is selected from D, E and S;
  $X_f$ is selected from A and S; and
iv) an amino acid sequence which has at least 85% identity to a sequence defined by iii).

It may be beneficial in some embodiments that said polypeptides exhibit high structural stability, such as resistance to chemical modifications, changes in physical conditions and proteolysis, during production or storage, as well as in vivo. Thus, in other embodiments where the IL-17A binding polypeptide as disclosed herein forms part of a three-helix bundle protein domain, the IL-17A binding polypeptide may comprise an amino acid sequence binding module (BMod) selected from:
v) K-[BM]-QPEQS $X_a X_b LLX_c$ EAKKL $X_d X_e X_f Q$ (SEQ ID NO:1297),
wherein
[BM] is an IL-17A binding motif as defined herein, provided that $X_{29}$ is R;
$X_a$ is selected from A and S;
$X_b$ is selected from N and E;
$X_c$ is selected from A, S and C;
$X_d$ is selected from E, N and S;
$X_e$ is selected from D, E and S;
$X_f$ is selected from A and S; and
vi) an amino acid sequence which has at least 85% identity to a sequence defined by v).

As discussed above, polypeptides comprising minor changes as compared to the above amino acid sequences, which changes do not largely affect the tertiary structure or function of the polypeptide, are also within the scope of the present disclosure. Thus, in some embodiments, sequence iv and vi) have at least at least 87%, such as at least 89%, such as at least 91%, such as at least 93%, such as at least 95%, such as at least 97% identity to a sequence defined by iii) or v), respectively.

In one embodiment, $X_a$ in sequence iii) or v) is A.

In one embodiment, $X_a$ in sequence iii) or v) is S.

In one embodiment, $X_b$ in sequence iii) or v) is N.

In one embodiment, $X_b$ in sequence iii) or v) is E.

In one embodiment, $X_c$ in sequence iii) or v) is A.

In one embodiment, $X_c$ in sequence iii) or v) is S.

In one embodiment, $X_c$ in sequence iii) or v) is C.

In one embodiment, $X_d$ in sequence iii) or v) is E.

In one embodiment, $X_d$ in sequence iii) or v) is N.

In one embodiment, $X_d$ in sequence iii) or v) is S.

In one embodiment, $X_e$ in sequence iii) or v) is D.

In one embodiment, $X_e$ in sequence iii) or v) is E.

In one embodiment, $X_e$ in sequence iii) or v) is S.

In one embodiment, $X_dX_e$ in sequence iii) or v) is selected from EE, ES, SD, SE and SS.

In one embodiment, $X_dX_e$ in sequence iii) or v) is ES.

In one embodiment, $X_dX_e$ in sequence iii) or v) is SE.

In one embodiment, $X_dX_e$ in sequence iii) or v) is SD.

In one embodiment, $X_f$ in sequence iii) or v) is A.

In one embodiment, $X_f$ in sequence iii) or v) is S.

In one embodiment, in sequence iii) or v), $X_a$ is A; $X_b$ is N; $X_c$ is A and $X_f$ is A.

In one embodiment, in sequence iii) or v), $X_a$ is S, $X_b$ is E; $X_c$ is A and $X_f$ is A.

In one embodiment, in sequence iii) or v), $X_a$ is A; $X_b$ is N; $X_c$ is C and $X_f$ is A.

In one embodiment, in sequence iii) or v), $X_a$ is S, $X_b$ is E; $X_c$ is S and $X_f$ is S.

In one embodiment, in sequence iii) or v), $X_a$ is S, $X_b$ is E; $X_c$ is S and $X_f$ is A.

In one embodiment, in sequence iii) or v), $X_a$ is S, $X_b$ is E; $X_c$ is A and $X_f$ is S.

In one embodiment, in sequence iii) or v), $X_a$ is S, $X_b$ is E; $X_c$ is C and $X_f$ is S.

In one embodiment, in sequence iii) or v), $X_a$ is A; $X_b$ is N; $X_c$ is A; $X_dX_e$ is ND and $X_f$ is A.

In one embodiment, in sequence iii) or v), $X_a$ is S, $X_b$ is E; $X_c$ is A; $X_dX_e$ is ND and $X_f$ is A.

In one embodiment, in sequence iii) or v), $X_a$ is A; $X_b$ is N; $X_c$ is C; $X_dX_e$ is ND and $X_f$ is A.

In one embodiment, in sequence iii) or v), $X_a$ is S, $X_b$ is E; $X_c$ is S, $X_dX_e$ is ND and $X_f$ is S.

In one embodiment, in sequence iii) or v), $X_a$ is S, $X_b$ is E; $X_c$ is S, $X_dX_e$ is ND and $X_f$ is A.

In one embodiment, in sequence iii) or v), $X_a$ is S, $X_b$ is E; $X_c$ is C; $X_dX_e$ is ND and $X_f$ is S.

In one embodiment, in sequence iii) or v), $X_a$ is A; $X_b$ is N; $X_c$ is A; $X_dX_e$ is SE and $X_f$ is A.

In one embodiment, in sequence iii) or v), $X_a$ is S, $X_b$ is E; $X_c$ is A; $X_dX_e$ is SE and $X_f$ is A.

In one embodiment, in sequence iii) or v), $X_a$ is A; $X_b$ is N; $X_c$ is C; $X_dX_e$ is SE and $X_f$ is A.

In one embodiment, in sequence iii) or v), $X_a$ is S, $X_b$ is E; $X_c$ is S, $X_dX_e$ is SE and $X_f$ is S.

In one embodiment, in sequence iii) or v), $X_a$ is S, $X_b$ is E; $X_c$ is A; $X_dX_e$ is SE and $X_f$ is S.

In one embodiment, in sequence iii) or v), $X_a$ is S, $X_b$ is E; $X_c$ is C; $X_dX_e$ is SE and $X_f$ is S.

In one embodiment, in sequence iii) or v), $X_a$ is A; $X_b$ is N; $X_c$ is A; $X_dX_e$ is ES and $X_f$ is A.

In one embodiment, in sequence iii) or v), $X_a$ is S, $X_b$ is E; $X_c$ is A; $X_dX_e$ is ES and $X_f$ is A.

In one embodiment, in sequence iii) or v), $X_a$ is A; $X_b$ is N; $X_c$ is C; $X_dX_e$ is ES and $X_f$ is A.

In one embodiment, in sequence iii) or v), $X_a$ is S, $X_b$ is E; $X_c$ is S, $X_dX_e$ is ES and $X_f$ is S.

In one embodiment, in sequence iii) or v), $X_a$ is S, $X_b$ is E; $X_c$ is C; $X_dX_e$ is ES and $X_f$ is S.

In one embodiment, in sequence iii) or v), $X_a$ is A; $X_b$ is N; $X_c$ is A; $X_dX_e$ is SD and $X_f$ is A.

In one embodiment, in sequence iii) or v), $X_a$ is S, $X_b$ is E; $X_c$ is A; $X_dX_e$ is SD and $X_f$ is A.

In one embodiment, in sequence iii) or v), $X_a$ is A; $X_b$ is N; $X_c$ is C; $X_dX_e$ is SD and $X_f$ is A.

In one embodiment, in sequence iii) or v), $X_a$ is S, $X_b$ is E; $X_c$ is S, $X_dX_e$ is SD and $X_f$ is S.

In one embodiment, in sequence iii) or v), $X_a$ is S, $X_b$ is E; $X_c$ is A; $X_dX_e$ is SD and $X_f$ is S.

In one embodiment, in sequence iii) or v), $X_a$ is S, $X_b$ is E; $X_c$ is C; $X_dX_e$ is SD and $X_f$ is S.

In yet a further embodiment, sequence iii) corresponds to the sequence from position 7 to position 55 in a sequence selected from the group consisting of SEQ ID NO:1-1216. In one embodiment, sequence iii) corresponds to the sequence from position 7 to position 55 in a sequence selected from the group consisting of SEQ ID NO:1-66, 1200, 1206 and 1214. In one embodiment, sequence iii) corresponds to the sequence from position 7 to position 55 in a sequence selected from the group consisting of SEQ ID NO:1-66. In one embodiment, sequence iii) corresponds to the sequence from position 7 to position 55 in a sequence selected from the group consisting of SEQ ID NO:1-35. In another embodiment, sequence iii) corresponds to the sequence from position 7 to position 55 in a sequence selected from the group consisting of SEQ ID NO:1-27. In one embodiment, sequence iii) corresponds to the sequence from position 7 to position 55 in a sequence selected from the group consisting of SEQ ID NO:1-10. In yet another embodiment, sequence iii) corresponds to the sequence from position 7 to position 55 in a sequence selected from the group consisting of SEQ ID NO:1-7. In one embodiment, sequence iii) corresponds to the sequence from position 7 to position 55 in a sequence selected from the group consisting of SEQ ID NO:1-4 and in another embodiment, sequence iii) corresponds to the sequence from position 7 to position 55 in SEQ ID NO:1.

Also, in a further embodiment, there is provided an IL-17A binding polypeptide, which comprises an amino acid sequence selected from:

vii) YA-[BMod]-AP (SEQ ID NO:1298),
wherein [BMod] is an IL-17A binding module as defined above; and viii) an amino acid sequence which has at least 86% identity to a sequence defined by vii).

In an alternative further embodiment, there is provided an IL-17A binding polypeptide, which comprises an amino acid sequence selected from:

ix) FA-[BMod]-AP (SEQ ID NO:1299),
wherein [BMod] is an IL-17A binding module as defined above; and x) an amino acid sequence which has at least 86% identity to a sequence defined by ix).

Alternatively, there is provided an IL-17A binding polypeptide, which comprises an amino acid sequence selected from:

xi) FN-[BMod]-AP (SEQ ID NO:1300),
wherein [BMod] is an IL-17A binding module as defined above; and xii) an amino acid sequence which has at least 86% identity to a sequence defined by xi).

As discussed above, polypeptides comprising minor changes as compared to the above amino acid sequences without largely affecting the tertiary structure and the function thereof also fall within the scope of the present disclosure. Thus, in some embodiments, the IL-17A binding polypeptides as defined above may for example have a sequence which is at least 88%, such as at least 90%, such as at least 92%, such as at least 94%, such as at least 96%, such as at least 98% identical to a sequence defined by vii), ix) or xi).

In some embodiments, the IL-17A binding motif may form part of a polypeptide comprising an amino acid sequence selected from

| SEQID NO: | |
|---|---|
| 1250 | ADNNFNK-[*BM*]-DPSQSANLLSEAKKLNESQAPK; |
| 1251 | ADNKFNK-[*BM*]-DPSQSANLLAEAKKLNDAQAPK; |
| 1252 | ADNKFNK-[*BM*]-DPSVSKEILAEAKKLNDAQAPK; |
| 1253 | ADAQQNNFNK-[*BM*]-DPSQSTNVLGEAKKLNESQAPK; |
| 1254 | AQHDE-[*BM*]-DPSQSANVLGEAQKLNDSQAPK; |
| 1255 | VDNKFNK-[*BM*]-DPSQSANLLAEAKKLNDAQAPK; |
| 1256 | AEAKYAK-[*BM*]-DPSESSELLSEAKKLNKSQAPK; |
| 1257 | VDAKYAK-[*BM*]-DPSQSSELLAEAKKLNDAQAPK; |
| 1258 | VDAKYAK-[*BM*]-DPSQSSELLAEAKKLNDSQAPK; |
| 1259 | AEAKYAK-[*BM*]-DPSQSSELLSEAKKLNDSQAPK; |
| 1260 | AEAKYAK-[*BM*]-DPSQSSELLSEAKKLNDSQAP; |
| 1261 | AEAKYAK-[*BM*]-DPSQSSELLSEAKKLNDAQAPK; |
| 1262 | AEAKYAK-[*BM*]-DPSQSSELLSEAKKLNDAQAP; |
| 1263 | AEAKFAK-[*BM*]-DPSQSSELLSEAKKLNDSQAPK; |
| 1264 | AEAKFAK-[*BM*]-DPSQSSELLSEAKKLNDSQAP; |
| 1265 | AEAKYAK-[*BM*]-DPSQSSELLAEAKKLNDAQAPK; |

-continued

| SEQID NO: | |
|---|---|
| 1266 | AEAKYAK-[*BM*]-DPSQSSELLSEAKKLSESQAPK; |
| 1267 | AEAKYAK-[*BM*]-DPSQSSELLSEAKKLSESQAP; |
| 1268 | AEAKFAK-[*BM*]-DPSQSSELLSEAKKLSESQAPK; |
| 1269 | AEAKFAK-[*BM*]-DPSQSSELLSEAKKLSESQAP; |
| 1270 | AEAKYAK-[*BM*]-DPSQSSELLAEAKKLSEAQAPK; |
| 1271 | AEAKYAK-[*BM*]-QPEQSSELLSEAKKLSESQAPK; |
| 1272 | AEAKYAK-[*BM*]-DPSQSSELLSEAKKLESSQAPK; |
| 1273 | AEAKYAK-[*BM*]-DPSQSSELLSEAKKLESSQAP; |
| 1274 | AEAKYAK-[*BM*]-DPSQSSELLAEAKKLESAQAPK; |
| 1275 | AEAKYAK-[*BM*]-QPEQSSELLSEAKKLESSQAPK; |
| 1276 | AEAKYAK-[*BM*]-DPSQSSELLSEAKKLSDSQAPK; |
| 1277 | AEAKYAK-[*BM*]-DPSQSSELLSEAKKLSDSQAP; |
| 1278 | AEAKYAK-[*BM*]-DPSQSSELLAEAKKLSDSQAPK; |
| 1279 | AEAKYAK-[*BM*]-DPSQSSELLAEAKKLSDAQAPK; |
| 1280 | AEAKYAK-[*BM*]-QPEQSSELLSEAKKLSDSQAPK; |
| 1281 | VDAKYAK-[*BM*]-DPSQSSELLSEAKKLNDSQAPK; |
| 1282 | VDAKYAK-[*BM*]-DPSQSSELLSEAKKLSESQAPK; |
| 1283 | VDAKYAK-[*BM*]-DPSQSSELLAEAKKLSEAQAPK; |
| 1284 | VDAKYAK-[*BM*]-QPEQSSELLSEAKKLSESQAPK; |
| 1285 | VDAKYAK-[*BM*]-DPSQSSELLSEAKKLESSQAPK; |
| 1286 | VDAKYAK-[*BM*]-DPSQSSELLAEAKKLESAQAPK; |
| 1287 | VDAKYAK-[*BM*]-QPEQSSELLSEAKKLESSQAPK; |
| 1288 | VDAKYAK-[*BM*]-DPSQSSELLSEAKKLSDSQAPK; |
| 1289 | VDAKYAK-[*BM*]-DPSQSSELLAEAKKLSDSQAPK; |
| 1290 | VDAKYAK-[*BM*]-DPSQSSELLAEAKKLSDAQAPK; |
| 1291 | VDAKYAK-[*BM*]-QPEQSSELLSEAKKLSDSQAPK; |
| 1292 | VDAKYAK-[*BM*]-DPSQSSELLAEAKKLNKAQAPK; |
| 1293 | AEAKYAK-[*BM*]-DPSQSSELLAEAKKLNKAQAPK; and |
| 1294 | ADAKYAK-[*BM*]-DPSQSSELLSEAKKLNDSQAPK; | wherein [BM] is an IL-17A binding motif as defined above.

In one embodiment, the IL-17A binding polypeptide comprises an amino acid sequence selected from:

xiii) VDAKYAK-[BM]-DPSQSSELLSEAKKLNDSQAPK (SEQ ID NO:1281), wherein [BM] is an IL-17A binding motif as defined above; and xiv) an amino acid sequence which has at least 86% identity to the sequence defined in xiii).

Again, polypeptides comprising minor changes as compared to the above amino acid sequences without largely affecting the tertiary structure and the function thereof are also within the scope of the present disclosure. Thus, in some embodiments, the IL-17A binding polypeptides as defined above may for example have a sequence which is at least 87%, such as at least 89%, such as at least 91%, such as at least 93%, such as at least 94%, such as at least 96%, such as at least 98% identical to the sequence defined by xiii).

Sequence xiii) in such a polypeptide may be selected from the group consisting of SEQ ID NO:1-1216. In one embodiment, sequence xiii) is selected from the group consisting of SEQ ID NO:1-66, 1200, 1206 and 1214. In one embodiment, sequence xiii) is selected from the group consisting of SEQ ID NO:1-66. In one embodiment, sequence xiii) is selected from the group consisting of SEQ ID NO:1-35. In another embodiment, sequence xiii) is selected from the group consisting of SEQ ID NO:1-27. In one embodiment, sequence xiii) is selected from the group consisting of SEQ ID NO:1-10. In one embodiment, sequence xiii) is selected from SEQ ID NO:1-7. In one embodiment, sequence xiii) is selected from the group consisting of SEQ ID NO:1-4. In one embodiment, sequence xiii) is SEQ ID NO:1.

In one embodiment, the IL-17A binding polypeptide comprises an amino acid sequence selected from:
xv) AEAKYAK-[BM]-DPSQSSELLSEAKKLNDSQAPK (SEQ ID NO:1259), wherein [BM] is an IL-17A binding motif as defined above; and
xvi) an amino acid sequence which has at least 86% identity to the sequence defined in xv).

Again, polypeptides comprising minor changes as compared to the above amino acid sequences without largely affecting the tertiary structure and the function thereof are also within the scope of the present disclosure. Thus, in some embodiments, the IL-17A binding polypeptides as defined above may for example have a sequence which is at least 87%, such as at least 89%, such as at least 91%, such as at least 93%, such as at least 94%, such as at least 96%, such as at least 98% identical to the sequence defined by xv).

Sequence xv) in such a polypeptide may be selected from the group consisting of SEQ ID NO:1217-1222. In one embodiment, sequence xv) is selected from the group consisting of SEQ ID NO:1218-1222. In one embodiment, sequence xv) is selected from the group consisting of SEQ ID NO:1219-1222. In another embodiment, sequence xv) is selected from the group consisting of SEQ ID NO:1219 and SEQ ID NO:1222. In one embodiment, sequence xv) is SEQ ID NO:1219.

The small size and robustness of the IL-17A binding domains of the present disclosure confer several advantages over conventional monoclonal antibody based therapies. Such advantages include the possibility of subcutaneous (s.c.) administration at higher doses than antibodies, alternative routes of administration, flexibility in formatting for superior potency and absence of Fc-mediated side effects. The small size combined with potential for very high solubility (>100 mg/ml) and stability allows for extreme molar amounts of drug in a small volume for s.c. injections. For systemic administration, this suggests outpatient "home use" treatment using convenient small prefilled syringes or auto-injectors, with low volume and well tolerated administration of doses. In addition, the capacity for high molar concentrations in drug preparations in combination with the ability to retain functional stability in diverse formulations opens up for topical (skin, eye, lung) administration routes. Psoriasis, asthma, uveitis and dry eye syndrome are examples of indications where alternative administration routes could be especially relevant in IL-17A mediated disease.

The terms "IL-17A binding" and "binding affinity for IL-17A" as used in this specification refer to a property of a polypeptide which may be tested for example by ELISA, by use of surface plasmon resonance (SPR) technology, or by use of the Kinetic Exclusion Assay (KinExA®). For example as described in the examples below, IL-17A binding affinity may be tested in an experiment in which samples of the polypeptide are captured on antibody coated ELISA plates and biotinylated IL-17A, followed by streptavidin conjugated HRP, are added. TMB substrate is added and the absorbance at 450 nm is measured using a multi-well plate reader, such as Victor$^3$ (Perkin Elmer). The skilled person may then interpret the results obtained by such experiments to establish at least a qualitative measure of the binding affinity of the polypeptide for IL-17A. If a quantitative measure is desired, for example to determine the EC50 value (the half maximal effective concentration) for the interaction, ELISA may also be used. The response of the polypeptides against a dilution series of biotinylated IL-17A are measured using ELISA as described above. The skilled person may then interpret the results obtained by such experiments and EC50 values may be calculated from the results using for example GraphPad Prism 5 and non-linear regression.

IL-17A binding affinity may also be tested in an experiment in which IL-17A, or a fragment thereof, is immobilized on a sensor chip of the surface plasmon resonance (SPR) instrument, and the sample containing the polypeptide to be tested is passed over the chip. Alternatively, the polypeptide to be tested is immobilized on a sensor chip of the instrument, and a sample containing IL-17A, or a fragment thereof, is passed over the chip. The skilled person may then interpret the results obtained by such experiments to establish at least a qualitative measure of the binding affinity of the polypeptide for IL-17A. If a quantitative measure is desired, for example to determine a $K_D$ value for the interaction, surface plasmon resonance methods may also be used. Binding values may for example be defined in a Biacore (GE Healthcare) or ProteOn XPR 36 (Bio-Rad) instrument. IL-17A is suitably immobilized on a sensor chip of the instrument, and samples of the polypeptide whose affinity is to be determined are prepared by serial dilution and injected in random order. $K_D$ values may then be calculated from the results using for example the 1:1 Langmuir binding model of the BIAevaluation 4.1 software, or other suitable software, provided by the instrument manufacturer.

Another method for determining binding affinity for IL-17A is the Kinetic Exclusion Assay (KinExA®; Sapidyne Instruments Inc, Boise, USA; Darling and Brault, 2004. Assay and Drug Dev Tech 2(6):647-657) for measurements of the equilibrium binding affinity and kinetics between unmodified molecules in solution. For affinity analysis, the equilibrium dissociation constant, $K_D$, and the rate of association, $k_a$, are experimentally determined, while the rate of dissociation, $k_d$, may be calculated based on the equation $k_d = K_D * k_a$.

A KinExA® $K_D$ analysis requires immobilization of one interaction partner (e.g. the titrated binding partner) to a solid phase, which is then used as a probe to capture the other interaction partner (e.g. the constant binding partner) free in solution once an equilibrium is reached. For each experiment, a series of solutions with a constant concentration of one binding partner and a titration of the other binding partner are equilibrated. The solutions are then briefly exposed to the solid phase and a portion of free constant binding partner is captured and labeled with a fluorescent secondary molecule. The short contact time with the solid phase is less than the time needed for dissociation of the pre-formed complex in solution, meaning that competition between the solution and the solid phase titrated binding partner is "kinetically excluded". Since the solid phase is only used as a probe for the free constant binding partner in each sample, the solution equilibrium is not altered during measurements. A $K_D$ value is calculated from signals generated from captured free constant binding partner, which are directly proportional to the concentration of free constant binding partner in the equilibrated sample. The data may be analyzed using the KinExA® Pro software and least squares analysis to fit the optimal solutions for the $K_D$ and the Active Binding site Concentration (ABC) to a curve representative of a stoichiometric relevant model, for instance a 1:1 reversible bi-molecular interaction.

Determination of binding kinetics may be done in a similar format as the equilibrium analysis, except measurements are collected "pre-equilibrium" and the binding signals are a function of time and total concentration of the titrated binding partner. There are two methods that can be used to determine the $k_a$. The "direct method" holds the concentrations of titrated and constant binding partners fixed, and the solution is probed over time. The amount of the free constant binding partner in the solution will decrease as the sample moves toward equilibrium. The "inject method" holds incubation time and one partner's concentration fixed, while titrating concentrations of the other partner. As the concentration of the titrated binding partner increases, the amount of free constant binding partner will decrease as more complexes are formed.

In one embodiment, the IL-17A binding polypeptide is capable of binding to IL-17A such that the $K_D$ value of the interaction is at most $1\times10^{-6}$ M, such as at most $1\times10^{-7}$ M, such as at most $1\times10^{-8}$ M, such as at most $1\times10^{-9}$ M.

In one embodiment, an IL-17A binding polypeptide according to any aspect disclosed herein is capable of binding to an IL-17A molecule selected from the group consisting of human IL-17A and murine IL-17A. In one embodiment, the IL-17A binding polypeptide is capable of binding to human IL-17A. In one embodiment, the IL-17A binding polypeptide is capable of binding to murine IL-17A. In one embodiment, the IL-17A binding polypeptide is capable of binding to human IL-17A and to murine IL-17A. In this regard, human IL-17A may comprise the amino acid sequence SEQ ID NO:1226, or an antigenically effective fragment thereof. Likewise, murine IL-17A may comprise the amino acid sequence SEQ ID NO:1227, or an antigenically effective fragment thereof.

The skilled person will understand that various modifications and/or additions can be made to an IL-17A binding polypeptide according to any aspect disclosed herein in order to tailor the polypeptide to a specific application without departing from the scope of the present disclosure.

For example, in one embodiment, there is provided an IL-17A binding polypeptide as described herein, which polypeptide has been extended by and/or comprises additional amino acids at the C terminus and/or N terminus. Such a polypeptide should be understood as a polypeptide having one or more additional amino acid residues at the very first and/or the very last position in the polypeptide chain, i.e. at the N- and/or C-terminus of sequence i) or ii). Thus, an IL-17A binding polypeptide may comprise any suitable number of additional amino acid residues, for example at least one additional amino acid residue. Each additional amino acid residue may individually or collectively be added in order to, for example, improve and/or simplify production, purification, stabilization in vivo or in vitro, coupling or detection of the polypeptide. Such additional amino acid residues may comprise one or more amino acid residues added for the purpose of chemical coupling. One example of this is the addition of a cysteine residue. Additional amino acid residues may also provide a "tag" for purification or detection of the polypeptide, such as a $His_6$ tag, a $(HisGlu)_3$ tag ("HEHEHE" tag) or a "myc" (c-myc) tag or a "FLAG" tag for interaction with antibodies specific to the tag or immobilized metal affinity chromatography (IMAC) in the case of the $His_6$-tag.

The further amino acids as discussed above may be coupled to the IL-17A binding polypeptide by means of chemical conjugation (using known organic chemistry methods) or by any other means, such as expression of the IL-17A binding polypeptide as a fusion protein or joined in any other fashion, either directly or via a linker, for example an amino acid linker.

The further amino acids as discussed above may for example comprise one or more polypeptide domain(s). A further polypeptide domain may provide the IL-17A binding polypeptide with another function, such as for example yet another binding function, an enzymatic function, a toxic function, a fluorescent signaling function or combinations thereof.

A further polypeptide domain may moreover provide another IL-17A binding moiety with the same IL-17A binding function. Thus, in a further embodiment, there is provided an IL-17A binding polypeptide in a multimeric form. Said multimer is understood to comprise at least two IL-17A binding polypeptides as disclosed herein as monomer units, the amino acid sequences of which may be the same or different. Multimeric forms of the polypeptides may comprise a suitable number of domains, each having an IL-17A binding motif, and each forming a monomer within the multimer. These domains may have the same amino acid sequence, but alternatively, they may have different amino acid sequences. In other words, the IL-17A binding polypeptide of the invention may form homo- or heteromultimers, for example homo- or heterodimers. In one embodiment, there is provided an IL-17A binding polypeptide, wherein said monomeric units are covalently coupled together. In another embodiment, said IL-17A binding polypeptide monomer units are expressed as a fusion protein. In one embodiment, there is provided an IL-17A binding polypeptide in dimeric form.

Additionally, "heterogenic" fusion polypeptides or proteins, or conjugates, in which an IL-17A binding polypeptide described herein, or multimer thereof, constitutes a first domain, or first moiety, and the second and further moieties have other functions than binding IL-17A, are also contemplated and fall within the ambit of the present disclosure. The second and further moiety/moieties of the fusion polypeptide or conjugate in such a protein suitably have a desired biological activity.

Thus, in a second aspect of the present disclosure, there is provided a fusion protein or a conjugate, comprising a first moiety consisting of an IL-17A binding polypeptide according to the first aspect, and a second moiety consisting of a polypeptide having a desired biological activity. In another embodiment, said fusion protein or conjugate may additionally comprise further moieties, comprising desired biological activities that can be either the same or different from the biological activity of the second moiety.

Non-limiting examples of a desired biological activity comprise a therapeutic activity, a binding activity and an enzymatic activity.

In one embodiment, the second moiety having a desired biological activity is a therapeutically active polypeptide.

Non-limiting examples of therapeutically active polypeptides are biomolecules, such as molecules selected from the group consisting of human endogenous enzymes, hormones, growth factors, chemokines, cytokines and lymphokines. Non-limiting examples of contemplated cytokines are IL-2, IL-4, IL-7, IL-10, IL-11, IL-13, IL-21, IL-27, IL-35, IFNβ and TGFβ. Non-limiting examples of contemplated chemokines are SDF-1/CXCL12, BCL/BCA-1/CXCL13, CXCL16, HCC1/CCL14, TARC/CCL17, PARC/CCL18, MIP-3β/ELC/CCL19, SLC/CCL21, CCL25/TECK and CCL27/CTACK.

Non-limiting examples of binding activities are binding activities which increase the in vivo half-life of the fusion protein or conjugate. In one particular embodiment, said binding activity is an albumin binding activity which increases the in vivo half-life of the fusion protein or conjugate. In one embodiment, said albumin binding activity is provided by the albumin binding domain of streptococcal protein G or a derivative thereof. In another particular embodiment, said binding activity is an FcRn binding activity which increases the in vivo half-life of the fusion protein or conjugate.

In one embodiment, the fusion protein or conjugate of this second aspect comprises two monomers of the IL-17A binding polypeptide of the first aspect, whose amino acid sequences may be the same or different, linked by an albumin binding moiety. In a specific embodiment of this construct, the fusion protein or conjugate comprises two IL-17A binding monomers with an albumin binding moiety between them. Said albumin binding moiety may e.g. be a "GA" albumin binding domain from streptococcal protein G, such as "GA3", or a derivative thereof as described in any one of WO2009/016043, WO2012/004384, WO2014/048977 and WO2015/091957.

In one embodiment, the format of such a fusion protein or conjugate is "Z-A-Z", where each "Z" individually is an IL-17A binding polypeptide as described herein, and "A" is an albumin binding domain. In one embodiment, such an IL-17A binding polypeptide with the "Z-A-Z" format is capable of binding to IL-17A such that the $K_D$ value of the interaction is at most $1 \times 10^{-10}$ M, such as at most $1 \times 10^{-11}$ M, such as at most $1 \times 10^{-12}$ M, such as at most $1 \times 10^{-13}$ M. In one embodiment, such a "Z-A-Z" polypeptide comprises an amino acid sequence selected from the group consisting of SEQ ID NO:1233-1247, for example selected from the group consisting of SEQ ID NO:1236, 1237 and 1242-1247, such as selected from the group consisting of SEQ ID NO:1236, 1244 and 1247 or the group consisting of SEQ ID NO:1237, 1244 and 1247. In an even more specific embodiment, the "Z-A-Z" polypeptide comprises an amino acid sequence selected from the group consisting of SEQ ID NO:1244 and 1245. In one embodiment, the "Z-A-Z" polypeptide comprises SEQ ID NO:1244.

In one embodiment, said binding activity is binding to an angiogenesis associated factor. Non-limiting examples of angiogenesis associated factors include fibroblast growth factor (FGF), fibroblast growth factor 1 (FGF-1), basic FGF, angiogenin 1 (Ang-1), angiogenin 2 (Ang-2), angiopoietin 1 (Angpt-1), angiopoietin 2 (Angpt-2), angiopoietin 3 (Angpt-3), angiopoietin 4 (Angpt-4), tyrosine kinase with immunoglobulin-like domains 1 (TIE-1), tyrosine kinase with immunoglobulin-like domains 2 (TIE-2), vascular endothelial growth factor receptor 1 (VEGFR-1), vascular endothelial growth factor receptor 2 (VEGFR-2), vascular endothelial growth factor receptor 3 (VEGFR-3), vascular endothelial growth factor A (VEGF-A), vascular endothelial growth factor B (VEGF-B), vascular endothelial growth factor C (VEGF-C), vascular endothelial growth factor D (VEGF-D), vascular endothelial growth factor E (VEGF-E), placental growth factor (PlGF), transforming growth factor β1 (TGF-β1), transforming growth factor β2 (TGF-β2), transforming growth factor β receptors (type I, type II and type III), matrix metalloproteinase (MMP), MET receptor tyrosine kinase (also denoted cMET and hepatocyte growth factor receptor (HGFR)), members of the Notch family of receptors and beta-catenin.

In one embodiment, said binding activity is binding to an immune response associated factor. Non-limiting examples of immune response associated factors include T-cell regulatory factors such as CD3, CD4, CD6, CD28, T-cell receptor α (TCRα), T-cell receptor β (TCRβ), cytotoxic T-lymphocyte-associated protein 4 (CTLA-4), and programmed cell death protein 1 (PD-1), programmed death-ligand 1 (PD-L1), programmed death-ligand 2 (PD-L2), B7 homolog 3 (B7-H3), B7 homolog 4 (B7-H4), herpes virus entry mediator (HVEM)/B- and T-lymphocyte attenuator (BTLA), killer inhibitory receptor (KIR), lymphocyte-activation gene 3 (LAG3), galectin-9 (Gal9)/T cell immunoglobulin mucin-3 (TIM3) and adenosine/alpha-2 adrenergic receptors (A2aR);

NK-cell recruitment factors such as CD16, natural killer cell lectin-like receptor gene 2D product (NKG2D), lymphocyte function-associated antigen 1 (LFA1) and the natural cytotoxicity receptors NKp30 and NKp40;

inflammation-associated factors such as
cytokines and their receptors, including tumor necrosis factors (TNF); tumor necrosis factor ligand super family (TNFSF) members TNFSF11/RANKL, TNFSF12/TWEAK, TNFSF13, TNFSF13B/BAFF/BLys, TNFSF14, TNFSF15, interleukins (IL) IL-1α, IL-1β, IL-2, IL-5, IL-6, IL-10, IL-12, IL-17B, IL-17C, IL-17D, IL-17E, IL-17F, IL-18, IL-22, IL-23, IL-26, IL-32, IL33 and IL-34; interferons INFα and INFγ; granulocyte colony-stimulating factor (GCSF), granulocyte colony-stimulating factor (GM-CSF); and inflammatory chemokines and their receptors, including IL-8/CXCL8, ENA-78/CXCL5, GROα/CXCL1, CTAP-III/CXCL7, IP-10/CXCL10, Mig/CXCL9, PF4/CXCL4, GCP-2/CXCL6, MCP-1/CCL2, MIP-1α/CCL3, MIP-3α/CCL20, RANTES/CCL5, lymphotactin/XCL1 and fractalkine/CX3CL1.

In particularly selected embodiments, the binding activity of said second moiety is binding to a target selected from the group consisting of TNF, IL-1β, IL-6, IL-17F and IL-23.

In one embodiment of either the first or second aspect of the present disclosure, there is provided an IL-17A binding polypeptide, fusion protein or conjugate which comprises an immune response modifying agent. Non-limiting examples of such immune response modifying agents include immunosuppressive or immunomodulating agents or other anti-inflammatory agents. For example, an IL-17A binding polypeptide, fusion protein or conjugate as described herein may comprise an agent selected from the group consisting of disease-modifying antirheumatic drugs (DMARDs), such as gold salts, azathioprine, methotrexate and leflunomide; calcineurin inhibitors, such as cyclosporin A or FK 506; modulators of lymphocyte recirculation; mTOR inhibitors, such as rapamycin; an ascomycin having immunosuppressive properties; glucocorticoids; corticosteroids; cyclophosphamide; immunosuppressive monoclonal antibodies, for example monoclonal antibodies with affinity for leukocyte receptors such as MHC, CD2, CD3, CD4, CD7, CD8, CD25, CD28, CD40, CD45, CD58, CD80, CD86 or their ligands; adhesion molecule inhibitors, such as LFA-1 antagonists, ICAM-1 or -3 antagonists, VCAM-4 antagonists or VLA-4 antagonists; anti-TNF agents, such as etanercept and monoclonal antibodies to TNF such as infliximab and adalimumab; inhibitors of proinflammatory cytokines; IL-1 blockers such as anakinra or IL-1 trap; IL-6 blockers; chemokine inhibitors; non-steroidal anti-inflammatory drugs (NSAIDs) such as aspirin; and anti-infectious agents and other immune response modulating agents; as well as combinations of any two or more of the above.

In one embodiment of either the first or second aspect of the present disclosure, there is provided an IL-17A binding polypeptide, fusion protein or conjugate which comprises a toxic compound. Non-limiting examples of such toxic compounds include calicheamicin, maytansinoid, neocarzinostatin, esperamicin, dynemicin, kedarcidin, maduropeptin, doxorubicin, daunorubicin, auristatin, ricin-A chain, modeccin, truncated *Pseudomonas* exotoxin A, diphtheria toxin and recombinant gelonin.

Recently, considerable progress has been made in the development of multispecific agents, such as antibodies with the ability to bind to more than one antigen, for example through engineering of the complementarity determining regions (CDRs) to address two antigens in a single antibody combining site (Bostrom et al, 2009, Science 323(5921): 1610-1614; Schaefer et al, 2011, Cancer Cell 20(4):472-486), via construction of heterodimeric antibodies using engineered Fc units (Carter, 2001, J Immunol Methods 248(1-2):7-15; Schaefer et al, 2011, Proc Natl Acad Sci USA 108(27):11187-11192) and via genetic fusion of auxiliary recognition units to N- or C-termini of light or heavy chains of full-length antibodies (Kanakaraj et al, 2012, MAbs 4(5):600-613, LaFleur et al, 2013, MAbs 5(2):208-218).

As discussed above, it may be beneficial for a polypeptide with affinity for IL-17A as disclosed herein to also exhibit affinity for another factor, such as an immune response associated factor, for example an inflammation-associated factor.

Thus, in a third aspect of the present disclosure, there is provided a complex comprising at least one IL-17A binding polypeptide as defined herein and at least one antibody or an antigen binding fragment thereof.

When used herein to denote the third aspect of the disclosure, the term "complex" is intended to refer to two or more associated polypeptide chains, one having an affinity for IL-17A by virtue of its IL-17A binding motif as defined above, and the other being an antibody or an antigen binding fragment thereof. These polypeptide chains may each contain different protein domains, as described amply above for the IL-17A binding polypeptide of the first and second aspects, and the resulting multiprotein complex can have multiple functions. "Complex" intends to refer to two or more polypeptides as defined herein, connected by covalent bonds, for example two or more polypeptide chains connected by covalent bonds through expression thereof as a recombinant fusion protein, or associated by chemical conjugation.

The third aspect provides a complex comprising an antibody or an antigen binding fragment thereof. As is well known, antibodies are immunoglobulin molecules capable of specific binding to a target (an antigen), such as a carbohydrate, polynucleotide, lipid, polypeptide or other, through at least one antigen recognition site located in the variable region of the immunoglobulin molecule. As used herein, the term "antibody or an antigen binding fragment thereof" encompasses not only full-length or intact polyclonal or monoclonal antibodies, but also antigen-binding fragments thereof, such as Fab, Fab', F(ab')$_2$, Fab$_3$, Fv and variants thereof, fusion proteins comprising one or more antibody portions, humanized antibodies, chimeric antibodies, minibodies, diabodies, triabodies, tetrabodies, linear antibodies, single chain antibodies, multispecific antibodies (e.g. bispecific antibodies) and any other modified configuration of the immunoglobulin molecule that comprises an antigen recognition site of the required specificity, including glycosylation variants of antibodies, amino acid sequence variants of antibodies and covalently modified antibodies. Further examples of modified antibodies and antigen binding fragments thereof include nanobodies, AlbudAbs, DARTs (dual affinity re-targeting), BiTEs (bispecific T-cell engager), TandAbs (tandem diabodies), DAFs (dual acting Fab), two-in-one antibodies, SMIPs (small modular immunopharmaceuticals), FynomAbs (fynomers fused to antibodies), DVD-Igs (dual variable domain immunoglobulin), CovX-bodies (peptide modified antibodies), duobodies and triomAbs. This listing of variants of antibodies and antigen binding fragments thereof is not to be seen as limiting, and the skilled person is aware of other suitable variants.

A full-length antibody comprises two heavy chains and two light chains. Each heavy chain contains a heavy chain variable region ($V_H$) and first, second and third constant regions ($C_H1$, $C_H2$ and $C_H3$). Each light chain contains a light chain variable region ($V_L$) and a light chain constant region ($C_L$). Depending on the amino acid sequence of the constant domain of its heavy chains, antibodies are assigned to different classes. There are six major classes of antibodies: IgA, IgD, IgE, IgG, IgM and IgY, and several of these may be further divided into subclasses (isotypes), e.g., IgG1, IgG2, IgG3, IgG4, IgA1 and IgA2. The term "full-length antibody" as used herein refers to an antibody of any class, such as IgD, IgE, IgG, IgA, IgM or IgY (or any sub-class thereof). The subunit structures and three-dimensional configurations of different classes of antibodies are well known.

An "antigen binding fragment" is a portion or region of an antibody molecule, or a derivative thereof, that retains all or a significant part of the antigen binding of the corresponding full-length antibody. An antigen binding fragment may comprise the heavy chain variable region ($V_H$), the light chain variable region ($V_L$), or both. Each of the $V_H$ and $V_L$ typically contains three complementarity determining regions CDR1, CDR2 and CDR3. The three CDRs in $V_H$ or $V_L$ are flanked by framework regions (FR1, FR2, FR3 and FR4). As briefly listed above, examples of antigen binding fragments include, but are not limited to: (1) a Fab fragment, which is a monovalent fragment having a $V_L$-$C_L$ chain and a $V_H$-$C_H1$ chain; (2) a Fab' fragment, which is a Fab fragment with the heavy chain hinge region, (3) a F(ab')$_2$ fragment, which is a dimer of Fab' fragments joined by the heavy chain hinge region, for example linked by a disulfide bridge at the hinge region; (4) an Fc fragment; (5) an Fv fragment, which is the minimum antibody fragment having the $V_L$ and $V_H$ domains of a single arm of an antibody; (6) a single chain Fv (scFv) fragment, which is a single polypeptide chain in which the $V_H$ and $V_L$ domains of an scFv are linked by a peptide linker; (7) an (scFv)$_2$, which comprises two $V_H$ domains and two $V_L$ domains, which are associated through the two $V_H$ domains via disulfide bridges and (8) domain antibodies, which can be antibody single variable domain ($V_H$ or $V_L$) polypeptides that specifically bind antigens.

Antigen binding fragments can be prepared via routine methods. For example, F(ab')$_2$ fragments can be produced by pepsin digestion of a full-length antibody molecule, and Fab fragments can be generated by reducing the disulfide bridges of F(ab')$_2$ fragments. Alternatively, fragments can be prepared via recombinant technology by expressing the heavy and light chain fragments in suitable host cells (e.g., E. coli, yeast, mammalian, plant or insect cells) and having them assembled to form the desired antigen-binding fragments either in vivo or in vitro. A single-chain antibody can be prepared via recombinant technology by linking a nucleotide sequence coding for a heavy chain variable region and a nucleotide sequence coding for a light chain variable region. For example, a flexible linker may be incorporated between the two variable regions. The skilled person is aware of methods for the preparation of both full-length antibodies and antigen binding fragments thereof.

Thus, in one embodiment, this aspect of the disclosure provides a complex as defined herein, wherein said at least one antibody or antigen binding fragment thereof is selected from the group consisting of full-length antibodies, Fab fragments, Fab' fragments, F(ab')$_2$ fragments, Fc fragments, Fv fragments, single chain Fv fragments, (scFv)$_2$ and domain antibodies. In one embodiment, said at least one antibody or antigen binding fragment thereof is selected from full-length antibodies, Fab fragments and scFv fragments. In one particular embodiment, said at least one antibody or antigen binding fragment thereof is a full-length antibody.

In one embodiment of said complex as defined herein, the antibody or antigen binding fragment thereof is selected from the group consisting of monoclonal antibodies, human antibodies, humanized antibodies, chimeric antibodies, and antigen-binding fragments thereof.

The term "monoclonal antibodies" as used herein refers to antibodies having monovalent affinity, meaning that each antibody molecule in a sample of the monoclonal antibody binds to the same epitope on the antigen, whereas the term "polyclonal antibodies" as used herein refers to a collection of antibodies that react against a specific antigen, but in which collection there may be different antibody molecules for example identifying different epitopes on the antigen. Polyclonal antibodies are typically produced by inoculation of a suitable mammal and are purified from the mammal's serum. Monoclonal antibodies are made by identical immune cells that are clones of a unique parent cell (for example a hybridoma cell line). The term "human antibody" as used herein refers to antibodies having variable and constant regions corresponding substantially to, or derived from, antibodies obtained from human subjects. The term "chimeric antibodies" as used herein, refers to recombinant or genetically engineered antibodies, such as for example mouse monoclonal antibodies, which contain polypeptides or domains from a different species, for example human, introduced to reduce the antibodies' immunogenicity. The term "humanized antibodies" refers to antibodies from non-human species whose protein sequences have been modified to increase their similarity to antibody variants produced naturally in humans, in order to reduce immunogenicity.

It may be beneficial for a complex as defined herein to, in addition to being capable of binding IL-17A, target at least one additional antigen, such as an antigen selected from the group consisting of an antigen associated with an angiogenesis related disorder and an antigen associated with the immune response. In one embodiment, said additional antigen is associated with angiogenesis. In one embodiment, said additional antigen is associated with the immune response.

In one embodiment, the antigen is associated with angiogenesis and is selected from the group consisting of fibroblast growth factor (FGF), fibroblast growth factor 1 (FGF-1), basic FGF, angiogenin 1 (Ang-1), angiogenin 2 (Ang-2), angiopoietin 1 (Angpt-1), angiopoietin 2 (Angpt-2), angiopoietin 3 (Angpt-3), angiopoietin 4 (Angpt-4), tyrosine kinase with immunoglobulin-like domains 1 (TIE-1), tyrosine kinase with immunoglobulin-like domains 2 (TIE-2), vascular endothelial growth factor receptor 1 (VEGFR-1), vascular endothelial growth factor receptor 2 (VEGFR-2), vascular endothelial growth factor receptor 3 (VEGFR-3), vascular endothelial growth factor A (VEGF-A), vascular endothelial growth factor B (VEGF-B), vascular endothelial growth factor C (VEGF-C), vascular endothelial growth factor D (VEGF-D), vascular endothelial growth factor E (VEGF-E), placental growth factor (PlGF), transforming growth factor β1 (TGF-β1), transforming growth factor β2 (TGF-β2), transforming growth factor β receptors (type I, type II and type III), matrix metalloproteinase (MMP), MET receptor tyrosine kinase (also denoted cMET and hepatocyte growth factor receptor (HGFR)), members of the Notch family of receptors and beta-catenin. In one embodiment, said antibody or fragment thereof is selected from the group consisting of AMG 780, AMG 386, MEDI-3617, nesvacumab, CVX-241, bevacizumab, ranibizumab, VGX100, CVX-241, ABP 215, PF-06439535, fresolimumab, metelimumab, onartuzumab, emibetuzumab and tarextumab.

In one embodiment, the antigen is associated with the immune response or a disorder of the immune system, and is selected from the group consisting of T-cell regulatory factors such as CD3, CD4, CD6, CD28, T-cell receptor α (TCRα), T-cell receptor β (TCRβ), cytotoxic T-lymphocyte-associated protein 4 (CTLA-4), and programmed cell death protein 1 (PD-1), programmed death-ligand 1 (PD-L1), programmed death-ligand 2 (PD-L2), B7 homolog 3 (B7-H3), B7 homolog 4 (B7-H4), herpes virus entry mediator (HVEM)/B- and T-lymphocyte attenuator (BTLA), killer inhibitory receptor (KIR), lymphocyte-activation gene 3 (LAG3), galectin-9 (Gal9)/T cell immunoglobulin mucin-3 (TIM3) and adenosine/alpha-2 adrenergic receptors (A2aR);

NK-cell recruitment factors such as CD16, natural killer cell lectin-like receptor gene 2D product (NKG2D), lymphocyte function-associated antigen 1 (LFA1) and the natural cytotoxicity receptors NKp30 and NKp40;

inflammation-associated factors such as cytokines and their receptors, including tumor necrosis factors (TNF); tumor necrosis factor ligand super family (TNFSF) members TNFSF11/RANKL, TNFSF12/TWEAK, TNFSF13, TNFSF13B/BAFF/BLys, TNFSF14, TNFSF15, interleukins (IL) IL-1α, IL-1β, IL-2, IL-5, IL-6, IL-10, IL-12, IL-17B, IL-17C, IL-17D, IL-17E, IL-17F, IL-18, IL-22, IL-23, IL-26, IL-32, IL33 and IL-34; interferons INFα and INFγ; granulocyte colony-stimulating factor (GCSF), granulocyte colony-stimulating factor (GM-CSF); and inflammatory chemokines and their receptors, including IL-8/CXCL8, ENA-78/CXCL5, GROα/CXCL1, CTAP-III/CXCL7, IP-10/CXCL10, Mig/CXCL9, PF4/CXCL4, GCP-2/CXCL6, MCP-1/CCL2, MIP-1a/CCL3, MIP-3a/CCL20, RANTES/CCL5, lymphotactin/XCL1 and fractalkine/CX3CL1.

In one embodiment, the antigen is selected from the group consisting of TNF, IL-1β, IL-6, IL-17F and IL-23.

In one embodiment, said antibody or fragment thereof is selected from the group consisting of visilizumab, otelixizumab, ipilimumab, tremelimumab, pembrolizumab, nivolumab, pidilizumab, MPDL3280A, MEDI-4736, MPDL3280A and lirilumab, and antigen-binding fragments thereof.

In one particular embodiment, said antigen is TNF. In one embodiment, said antibody or fragment thereof is selected from the group consisting of adalimumab, infliximab, golimumab, certolimumab pegol, and antigen binding fragments thereof. In another embodiment said antibody or fragment thereof is a full-length antibody selected from the group consisting of adalimumab, infliximab, golimumab and certolimumab pegol. In one particular embodiment, said antibody or antigen binding fragment thereof is adalimumab or an antigen binding fragment thereof, for example full-length adalimumab.

The complex as described herein may for example be present in the form of a fusion protein or a conjugate. Thus, said at least one IL-17A binding polypeptide and said at least one antibody, or antigen binding fragment thereof, may be coupled by means of chemical conjugation (using known organic chemistry methods) or by any other means, such as expression of the complex as a fusion protein or joined in any other fashion, either directly or via a linker, for example an amino acid linker.

Thus, in one embodiment, there is provided a complex as defined herein, wherein said complex is a fusion protein or a conjugate. In one embodiment, said complex is a fusion protein. In another embodiment, said complex is a conjugate. In one embodiment of said complex, said IL-17A binding polypeptide is attached to the N-terminus or C-terminus of the heavy chain of said antibody or antigen binding fragment thereof. In another embodiment, said IL-17A binding polypeptide is attached to the N-terminus or C-terminus of the light chain of said antibody or antigen binding fragment thereof. In one embodiment, said IL-17A binding polypeptide is attached to the N-terminus and/or C-terminus of the light chain and heavy chain of said antibody or antigen binding fragment thereof. For example, the IL-17A binding polypeptide may be attached to only the N-terminus of the heavy chain(s), only the N-terminus of the light chain(s), only the C-terminus of the heavy chain(s), only the C-terminus of the light chain(s), both the N-terminus and the C-terminus of the heavy chain(s), both the N-terminus and the C-terminus of the light chain(s), only the C-terminus of the light chain(s) and the N-terminus of the heavy chain(s), only the C-terminus of the heavy chain(s) and the N-terminus of the light chain(s), of said antibody or antigen binding fragment thereof.

As the skilled person understands, the construction of a fusion protein often involves use of linkers between functional moieties to be fused. The skilled person is aware of different kinds of linkers with different properties, such as flexible amino acid linkers, rigid amino acid linkers and cleavable amino acid linkers. Linkers have been used to for example increase stability or improve folding of fusion proteins, to increase expression, improve biological activity, affinity and/or binding, enable targeting and alter pharmacokinetics of fusion proteins. Thus, in one embodiment, the IL-17A binding polypeptide, fusion protein, conjugate or complex as defined herein further comprises at least one linker. The linker may for example be selected from the group consisting of flexible amino acid linkers, rigid amino acid linkers and cleavable amino acid linkers. Alternatively, the linker may be a non-peptidic linker. In one embodiment of a fusion protein or conjugate as disclosed herein, said linker is arranged between a first moiety consisting of an IL-17A binding polypeptide as defined herein and a second moiety consisting of a polypeptide having a desired biological activity. In one embodiment of a complex as disclosed herein, said linker is arranged between said IL-17A binding polypeptide and said antibody or antigen binding fragment thereof. The skilled person will appreciate that the presence of linker arranged in any of above mentioned contexts does not exclude the presence of additional linkers in the same or any other context.

Flexible linkers are often used when the joined domains require a certain degree of movement or interaction, and may be particularly useful in some embodiments of the IL-17A binding polypeptide, fusion protein, conjugate or complex as defined herein. Such linkers are generally composed of small, non-polar (for example G) or polar (for example S or T) amino acids. Some flexible linkers primarily consist of stretches of G and S residues, for example (GGGGS(SEQ ID NO:1301))$_p$ and (SSSSG(SEQ ID NO:1302))$_p$. Adjusting the copy number "p" allows for optimization of the linker in order to achieve appropriate separation between the functional moieties or to maintain necessary inter-moiety interaction. Apart from G and S linkers, other flexible linkers are known in the art, such as G and S linkers containing additional amino acid residues, such as T, A, K and E, to maintain flexibility, as well as polar amino acid residues to improve solubility.

In one embodiment, said linker is a flexible linker comprising glycine (G), serine (S) and/or threonine (T) residues. In one embodiment, said linker comprises a sequence with a general formula selected from $(G_nS_m)_p$ and $(S_nG_m)_p$, wherein, independently, n=1-7, m=0-7, n+m 8 and p=1-10. In one embodiment, n=1-5. In one embodiment, m=0-5. In one embodiment, p=1-5. In a more specific embodiment, n=4, m=1 and p=1-4.

In one embodiment, said linker comprises a sequence selected from the group consisting of $G_4S$(SEQ ID NO:1301), $(G_4S)_2$ (SEQ ID NO:1303), $(G_4S)_3$ (SEQ ID NO:1304) and $(G_4S)_4$ (SEQ ID NO:1305).

In one embodiment, said linker comprises a sequence with the general formula $GT(G_nS_m)_p$, wherein, independently, n=1-7, m=0-7, n+m 8 and p=1-10. In one embodiment, n=1-5. In one embodiment, m=0-5. In one embodiment, p=1-5. In a more specific embodiment, n=4, m=1 and p=1-4. Thus, in one embodiment wherein n=4, said linker comprises $GT(G_4S$(SEQ ID NO:1301))$_p$. In one specific embodiment, n=4 and p=1, so that said linker comprises $GTG_4S$ (SEQ ID NO:1306). In one embodiment, said linker comprises a sequence selected from the group consisting of $GT(G_4S$[SEQ ID NO:1301])$_p$TS, $GT(G_4S$[SEQ ID NO:1301])$_p$PR and $GT(G_4S$[SEQ ID NO:1301])$_p$PK.

In one embodiment, said linker comprises a sequence with the general formula $GAP(G_nS_m)_p$, wherein, independently, n=1-7, m=0-7, n+m 8 and p=1-10. In one embodiment, n=1-5. In one embodiment, m=0-5. In one embodiment, p=1-5. In a more specific embodiment, n=4, m=1 and p=1-4. Thus, in one embodiment wherein n=4, said linker comprises $GAP(G_4S)_p$. In one specific embodiment, n=4 and p=1, so that said linker comprises $GAPG_4S$ (SEQ ID NO:1307). In one embodiment, said linker comprises a sequence selected from the group consisting of $GAP(G_4S$[SEQ ID NO:1301])$_p$TS, $GAP(G_4S$[SEQ ID NO:1301])$_p$PR and $GAP(G_4S$[SEQ ID NO:1301])$_p$PK.

In one embodiment, said linker comprises a sequence selected from the group consisting of $KL(G_4S$[SEQ ID NO:1301])$_p$, $LQ(G_4S$[SEQ ID NO:1301])$_p$ and $YV(G_4S$[SEQ ID NO:1301])$_p$PK. In one embodiment, said linker comprises a sequence selected from the group consisting of $S_4G$ (SEQ ID NO:1302), $(S_4G)_3$ (SEQ ID NO:1308), $(S_4G)_4$ (SEQ ID NO:1309) and $(S_4G)_8$ (SEQ ID NO:1310) In one embodiment, said linker comprises a sequence selected from the group consisting of VDGS(SEQ ID NO:1311), ASGS (SEQ ID NO:1312) and VEGS(SEQ ID NO:1313). In a specific embodiment, said linker comprises ASGS(SEQ ID NO:1312).

With regard to the description above of fusion proteins, conjugates or complexes incorporating an IL-17A binding polypeptide according to the disclosure, it is to be noted that the designation of first, second and further moieties is made for clarity reasons to distinguish between IL-17A binding polypeptide or polypeptides according to the invention on the one hand, and moieties exhibiting other functions on the other hand. These designations are not intended to refer to the actual order of the different domains in the polypeptide chain of the fusion protein, conjugate or complex. Thus, for example, said first moiety may without restriction appear at the N-terminal end, in the middle, or at the C-terminal end of the fusion protein, conjugate or complex.

The disclosure furthermore encompasses polypeptides in which the IL-17A binding polypeptide according to the first aspect, the IL-17A binding polypeptide as comprised in a fusion protein or conjugate according to the second aspect or in a complex according to the third aspect, further comprises a label, such as a label selected from the group consisting of fluorescent dyes and metals, chromophoric dyes, chemiluminescent compounds and bioluminescent proteins, enzymes, radionuclides and particles. Such labels may for example be used for detection of the polypeptide.

In embodiments where the labeled IL-17A binding polypeptide comprises an IL-17A binding polypeptide according to the first aspect of the disclosure and a label, this labeled polypeptide may be used for indirect labeling of IL-17A expressing cells, such as cells of inflammation-associated cancers. Non-limiting examples of inflammation-associated cancers include gastric cancers, colorectal cancers, non-small cell lung cancers, hepatocellular carcinomas and adenocarcinomas (Wu et al., 2014 Tumour Biol. 35(6):5347-56; Wu et al., 2012 PLoS One 7(12); Zhang et al. 2012 Asian Pac J Cancer Prev 13(8):3955-60, Liu et al., 2011 Biochem Biophys Res Commun. 407(2):348-54).

In other embodiments, the labeled IL-17A binding polypeptide is present as a moiety in a fusion protein, conjugate or complex also comprising a second and possible further moiety having a desired biological activity. The label may in some instances be coupled only to the IL-17A binding polypeptide, and in some instances both to the IL-17A binding polypeptide and to the second moiety of the fusion protein or conjugate and/or the antibody or antigen binding fragment of the complex. Furthermore, it is also possible that the label may be coupled to a second moiety, or antibody or antigen binding fragment thereof only and not to the IL-17A binding moiety. Hence, in yet another embodiment, there is provided an IL-17A binding polypeptide comprising a second moiety, wherein said label is coupled to the second moiety only. In another embodiment, there is provided a complex as defined herein, wherein said label is coupled to the antibody or antigen binding fragment thereof only.

In one embodiment, said IL-17A binding polypeptide, fusion protein, conjugate or complex as described herein comprises a chelating environment provided by a polyaminopolycarboxylate chelator conjugated to the IL-17A binding polypeptide via a thiol group of a cysteine residue or an amine group of a lysine residue.

In embodiments where the IL-17A binding polypeptide, fusion protein, conjugate or complex is radiolabeled, such a radiolabeled polypeptide may comprise a radionuclide. A majority of radionuclides have a metallic nature and metals are typically incapable of forming stable covalent bonds with elements presented in proteins and peptides. For this reason, labeling of proteins and peptides with radioactive metals is performed with the use of chelators, i.e. multidentate ligands, which form non-covalent compounds, called chelates, with the metal ions. In an embodiment of the IL-17A binding polypeptide, fusion protein, conjugate or complex, the incorporation of a radionuclide is enabled through the provision of a chelating environment, through which the radionuclide may be coordinated, chelated or complexed to the polypeptide.

One example of a chelator is the polyaminopolycarboxylate type of chelator. Two classes of such polyaminopolycarboxylate chelators can be distinguished: macrocyclic and acyclic chelators.

In one embodiment, the IL-17A binding polypeptide, fusion protein or conjugate comprises a chelating environment provided by a polyaminopolycarboxylate chelator conjugated to the IL-17A binding polypeptide via a thiol group of a cysteine residue or an epsilon amine group of a lysine residue.

The most commonly used macrocyclic chelators for radioisotopes of indium, gallium, yttrium, bismuth, radio-actinides and radiolanthanides are different derivatives of DOTA (1,4,7,10-tetraazacyclododecane-1,4,7,10-tetraacetic acid). In one embodiment, a chelating environment of the IL-17A polypeptide, fusion protein, conjugate or complex is provided by DOTA or a derivative thereof. More specifically, in one embodiment, the chelating polypeptides encompassed by the present disclosure are obtained by reacting the DOTA derivative 1,4,7,10-tetraazacyclododecane-1,4,7-trisacetic acid-10-maleimidoethylacetamide (maleimidomonoamide-DOTA) with said polypeptide.

Additionally, 1,4,7-triazacyclononane-1,4,7-triacetic acid (NOTA) and derivatives thereof may be used as chelators. Hence, in one embodiment, there is provided an IL-17A binding polypeptide, fusion protein, conjugate or complex, wherein the the polyaminopolycarboxylate chelator is 1,4,7-triazacyclononane-1,4,7-triacetic acid or a derivative thereof.

The most commonly used acyclic polyaminopolycarboxylate chelators are different derivatives of DTPA (diethylenetriamine-pentaacetic acid). Hence, polypeptides having a chelating environment provided by diethylenetriaminepentaacetic acid or derivatives thereof are also encompassed by the present disclosure.

In one embodiment, said IL-17A binding polypeptide, fusion protein, conjugate or complex as described herein further comprises one or more polyethylene glycol (PEG) moieties, e.g. in order to improve pharmacokinetic properties of the molecule.

In a fourth aspect of the present disclosure, there is provided a polynucleotide encoding an IL-17A binding polypeptide or a fusion protein as described herein; an expression vector comprising said polynucleotide; and a host cell comprising said expression vector.

Also encompassed by this disclosure is a method of producing a polypeptide or fusion protein as described above, comprising culturing said host cell under conditions permissive of expression of said polypeptide from its expression vector, and isolating the polypeptide.

The IL-17A binding polypeptide of the present disclosure may alternatively be produced by non-biological peptide synthesis using amino acids and/or amino acid derivatives having protected reactive side-chains, the non-biological peptide synthesis comprising step-wise coupling of the amino acids and/or the amino acid derivatives to form a polypeptide according to the first aspect having protected reactive side-chains, removal of the protecting groups from the reactive side-chains of the polypeptide, and folding of the polypeptide in aqueous solution.

It should be understood that the IL-17A binding polypeptide according to the present disclosure may be useful as a therapeutic, diagnostic or prognostic agent in its own right or as a means for targeting other therapeutic or diagnostic agents, with e.g. direct or indirect effects on IL-17A. A direct therapeutic effect may for example be accomplished by inhibiting IL-17A signaling, such as by blocking IL-17A from binding to one or more of its receptors.

In another aspect, there is provided a composition comprising an IL-17A binding polypeptide, fusion protein, conjugate or complex as described herein and at least one pharmaceutically acceptable excipient or carrier. In one embodiment, said composition further comprises at least one additional active agent, such as at least two additional active agents, such as at least three additional active agents. Non-limiting examples of additional active agents that may prove useful in such a composition are the therapeutically active polypeptides, immune response modifying agents and toxic compounds described herein.

The skilled person will appreciate that said IL-17A binding polypeptide, fusion protein, conjugate or complex, or a pharmaceutical composition comprising an anti-IL-17A binding polypeptide, fusion protein, conjugate or complex as described herein may be administered to a subject using standard administration techniques, such as including oral, topical, intravenous, intraperitoneal, subcutaneous, pulmonary, transdermal, intramuscular, intranasal, buccal, sublingual or suppository administration. Thus, in one embodiment there is provided an IL-17A binding polypeptide, fusion protein, conjugate or complex or a pharmaceutical composition as described herein for oral, topical, intravenous, intraperitoneal, subcutaneous, pulmonary, transdermal, intramuscular, intranasal, buccal, sublingual or suppository administration. In one particular embodiment there is provided an IL-17A binding polypeptide, fusion protein, conjugate or complex or a pharmaceutical composition as described herein for oral administration. In another particular embodiment there is provided an IL-17A binding polypeptide, fusion protein, conjugate or complex or a pharmaceutical composition as described herein for topical administration, such as topical administration to the eye.

IL-17A may also serve as a valuable marker to for diagnosis and prognosis of certain cancers, such as inflammation-associated cancers for example gastric cancers, colorectal cancers, non-small cell lung cancers, hepatocellular carcinomas and adenocarcinomas. For example, IL-17 has been linked to the prognosis and poor survival in patients suffering from colorectal carcinoma and hepatocellular carcinoma.

Hence, in another aspect of the present disclosure, there is provided an IL-17A binding polypeptide, fusion protein, conjugate, complex or composition as described herein for use as a medicament, a diagnostic agent or a prognostic agent.

In one embodiment, there is provided an IL-17A binding polypeptide, fusion protein, conjugate, complex or composition as described herein, for use as a medicament to modulate IL-17A function in vivo. As used herein, the term "modulate" refers to changing the activity, such as rendering IL-17A function hypomorph, partially inhibiting or fully inhibiting IL-17A function.

Non-limiting examples of IL-17A associated conditions or diseases, wherein the IL-17A binding polypeptides may be useful for treatment, prognosis and/or diagnosis of include arthritis, such as rheumatoid arthritis, arthritis chronica progrediente, arthritis deformans and rheumatic diseases, diseases involving bone loss, inflammatory pain, spondyloarhropathies including ankylosing spondylitis, Reiter syndrome, reactive arthritis, psoriatic arthritis, enterophathc arthritis, pauciarticular rheumatoid arthritis, polyarticular rheumatoid arthritis, systemic onset rheumatoid arthritis, osteoarthritis; hypersensitivity conditions, such as hypersensitivity (including both airways hypersensitivity and dermal hypersensitivity), allergies and responses to allergen exposure; gastrointestional conditions or diseases, such as autoimmune inflammatory bowel disease (including e.g. ulcerative colitis, Crohn's disease and Irritable Bowel Syndrome), celiac disease (idiopathic sprue), intraperitoneal abscesses and adhesions, primary biliary sclerosis, sclerosing cholangitis, autoimmune hepatitis, viral hepatitis, chronic active hepatitis and *Helicobacter pylori* associated gastritis; ophthalmic conditions and diseases, such as endocrine ophthalmopathy, Graves disease, uveitis (anterior and posterior), keratoconjunctivitis sicca (dry eye disease), vernal keratoconjunctivitis, herpetic stromal keratitis and dry eye disease; nephrological conditions and disease, such as glomerulonephritis (with and without nephrotic syndrome, e.g. including idiopathic nephrotic syndrome or minimal change nephropathy); acute conditions and disease, such as acute and hyperacute inflammatory reactions, septic shock (e.g., endotoxic shock and adult respiratory distress syndrome), meningitis, pneumonia, severe burns, acute infections, septicemia, stroke and ischemic; cachexia (wasting syndrome), such as cachexia associated with morbid TNF release, cachexia consequent to infection, cachexia associated with cancer, cachexia associated with organ dysfunction and AIDS-related cachexia; bone related conditions and diseases, such as diseases of bone metabolism including osteoarthritis, osteoporosis, inflammatory arthritides, bone loss such as age-related bone loss, periodontal disease, loosening of bone implants and bone erosion; juvenile conditions and diseases, such as juvenile rheumatoid arthritis, pauciarticular juvenile rheumatoid arthritis, polyarticular juvenile rheumatoid arthritis, systemic onset juvenile rheumatoid arthritis, juvenile ankylosing spondylitis, juvenile enteropathic arthritis, juvenile reactive arthritis, juvenile Reiter's Syndrome, SEA Syndrome (Seronegativity, Enthesopathy, Arthropathy Syndrome), juvenile dermatomyositis, juvenile psoriatic arthritis, juvenile scleroderma, juvenile systemic lupus erythematosus and juvenile vasculitis; vasculitis including vasculitis of large vessels, such as Polymyalgia rheumatica, Takayasu's arteritis and Temporal arteritis, vasculitis of medium vessels, such as Buerger's disease, Cutaneous vasculitis, Kawasaki disease and Polyarteritis *nodosa*, vasculitis of small vessels, such as Behcet's syndrome, Churg-Strauss syndrome, cutaneous vasculitis, Henoch-Schönlein purpura, microscopic polyangiitis, Wegener's granulomatosis and Golfer's vasculitis, vasculitis of variable vessels and arteritis; dermatological conditions or diseases, such as psoriasis, plaque psoriasis, guttate psoriasis, inverse psoriasis, pustular psoriasis, erythrodermic psoriasis, dermatitis and atopic dermatitis; pulmonary conditions and diseases, such as obstructive or inflammatory airways diseases, asthma, bronchitis, COPD, pneumoconiosis, pulmonary emphysema, acute and hyperacute inflammatory reactions, interstitial lung fibrosis, airway inflammation and bronchial asthma; metabolic conditions and diseases, such as atherosclerosis, dyslipidemia and Type I diabetes mellitus; as well as other systemic autoimmune conditions and diseases, such as systemic lupus erythematosus (SLE), lupus nephritis, polychondritis, myasthenia gravis, Steven-Johnson syndrome, tumors, myositis, dermatomyositis, adult-onset Still's disease, polymyalgia rheumatica, sarcoidosis, scleroderma, sclerosis, systemic sclerosis, Sjogren's syndrome, multiple sclerosis (MS), Guillain-Barre disease, Addison's disease and Raynaud's phenomenon.

The IL-17A binding polypeptides as disclosed herein may furthermore be useful for the treatment of recipients of heart, lung, combined heart-lung, liver, kidney, pancreatic, skin or corneal transplants, including allograft rejection or xenograft rejection, and for the prevention of graft-versus-host disease, such as following bone marrow transplant, and organ transplant associated arteriosclerosis.

The IL-17A binding polypeptides as disclosed herein may furthermore be useful for the treatment, diagnosis or prognosis of inflammation-associated cancers. The term "cancer" as used herein refers to tumor diseases and/or cancer, such as metastatic or invasive cancers, for example lung cancer, non small cell lung (NSCL) cancer, bronchioloalviolar cell lung cancer, bone cancer, pancreatic cancer, skin cancer, cancer of the head or neck, cutaneous or intraocular melanoma, rectal cancer, cancer of the anal region, stomach cancer, gastric cancer, colon cancer, colorectal cancer, cancer of the small intestines, esophageal cancer, liver cancer, pancreas cancer, breast cancer, ovarian cancer, uterine cancer, carcinoma of the fallopian tubes, carcinoma of the endometrium, carcinoma of the cervix, carcinoma of the vagina, carcinoma of the vulva, Hodgkin's Disease, cancer of the endocrine system, cancer of the thyroid gland, cancer of the parathyroid gland, cancer of the adrenal gland, sarcoma of soft tissue, cancer of the urethra, cancer of the penis, prostate cancer, bladder cancer, cancer of the kidney or ureter, renal cell carcinoma, carcinoma of the renal pelvis, mesothelioma, hepatocellular carcinoma, biliary cancer, neoplasms of the central nervous system (CNS), spinal axis tumors, brain stem glioma, glioblastoma multiforme, astrocytomas, schwanomas, ependymonas, medulloblastomas, meningiomas, squamous cell carcinomas, pituitary adenoma, adenocarcinomas, lymphoma, lymphocytic leukemia, or cancer of unknown origin, or other hyperplastic or neoplastic IL-17A associated condition, including refractory versions of any of the above cancers or a combination of one or more of the above cancers or hyperproliferative diseases.

Non-limiting examples of inflammation-associated cancers include gastric cancers, colorectal cancers, non-small cell lung cancers, hepatocellular carcinomas and adenocarcinomas.

In one embodiment, there is provided an IL-17A binding polypeptide, fusion protein, conjugate, complex or composition for use in the treatment, diagnosis or prognosis of an IL-17A associated condition, such as a condition selected from the group consisting of inflammatory diseases, autoimmune diseases and cancer, such as inflammatory diseases and autoimmune diseases. In one embodiment, said condition is selected from the group consisting of inflammatory conditions, allergic conditions, hypersensitivity reactions, autoimmune diseases, severe infections and transplant rejections.

In one particular embodiment, said IL-17A associated condition is selected from the group consisting of rheumatoid arthritis, ankylosing spondylitis, psoriatic arthritis, psoriasis, multiple sclerosis, systemic lupus erythematosus, uveitis and dry eye disease.

In an even more particular embodiment, said IL-17A associated condition is psoriasis.

In another embodiment, said IL-17A associated condition is an inflammation-associated cancer, such as a cancer selected from the group consisting of gastric cancers, colorectal cancers, non-small cell lung cancers, hepatocellular carcinomas and adenocarcinomas.

In a related aspect, there is provided a method of detecting IL-17A, comprising providing a sample suspected to contain IL-17A, contacting said sample with an IL-17A binding polypeptide, fusion protein, conjugate, complex or composition as described herein, and detecting the binding of the IL-17A binding polypeptide, fusion protein, conjugate, complex or composition to indicate the presence of IL-17A in the sample. In one embodiment, said method further comprises an intermediate washing step for removing non-bound polypeptide, fusion protein, conjugate, complex or composition, after contacting the sample.

In one embodiment, said method is a diagnostic or prognostic method, for determining the presence of IL-17A in a subject, the method comprising the steps:
   contacting the subject, or a sample isolated from the subject, with an IL-17A binding polypeptide, fusion protein, conjugate, complex or composition as described herein, and
   obtaining a value corresponding to the amount of the IL-17A binding polypeptide, fusion protein, conjugate, complex or composition that has bound in said subject or to said sample.

In one embodiment, said method further comprises an intermediate washing step for removing non-bound polypeptide, fusion protein, conjugate, complex or composition, after contacting the subject or sample and before obtaining a value.

In one embodiment, said method further comprises a step of comparing said value to a reference. Said reference may be scored by a numerical value, a threshold or a visual indicator, for example based on a color reaction. The skilled person will appreciate that different ways of comparison to a reference are known in the art may be suitable for use.

In one embodiment of such a method, said subject is a mammalian subject, such as a human subject.

In one embodiment, said method is performed in vivo.

In one embodiment, said method is performed in vitro.

In a related aspect, there is provided a method of treatment of an IL-17A associated condition, comprising administering to a subject in need thereof an effective amount of an IL-17A binding polypeptide, fusion protein, conjugate, complex or composition as described herein. In a more specific embodiment of said method, the IL-17A binding polypeptide, fusion protein, conjugate, complex or composition as described herein modulates IL-17A function in vivo.

In one embodiment, said IL-17A associated condition is selected from the group consisting of inflammatory diseases, autoimmune diseases and cancer, such as a group consisting of inflammatory diseases and autoimmune diseases. In one particular embodiment of said aspect, the IL-17A associated condition is selected from the group consisting of inflammatory conditions, allergic conditions, hypersensitivity reactions, autoimmune diseases, severe infections and transplant rejections. In one embodiment, said IL-17A associated condition is selected from the group consisting of rheumatoid arthritis, ankylosing spondylitis, psoriatic arthritis, psoriasis, multiple sclerosis, systemic lupus erythematosus, uveitis and dry eye disease. In a more specific embodiment, said IL-17A associated condition is psoriasis. In another embodiment, said IL-17A associated condition is cancer, such as a cancer selected from the group consisting of gastric cancers, colorectal cancers, non-small cell lung cancers, hepatocellular carcinomas and adenocarcinomas.

It may be beneficial to administer a therapeutically effective amount of an IL-17A binding polypeptide, fusion protein, conjugate, complex or composition as described herein together with least one second drug substance, such as an immune response modifying agent, toxic compound or an anti-cancer agent.

As used herein, the term "co-administration" encompasses concomitant administration and administration in sequence. Thus, in one embodiment, there is provided a method as defined above, further comprising co-administration of an immune response modulating agent. In another embodiment, there is provided a method as defined above, further comprising co-administration of an additional anti-inflammatory agent. In another embodiment, there is provided a method as defined above, further comprising co-administration of a toxic compound. In another embodiment, there is provided a method as defined above, further comprising co-administration of an anti-cancer agent.

Non-limiting examples of immune response modulating agents and toxic compounds are given above. Non-limiting examples of anti-cancer agents include agents selected from the group consisting of auristatin, anthracycline, calicheamycin, combretastatin, doxorubicin, duocarmycin, the CC-1065 anti-tumorantibiotic, ecteinsascidin, geldanamycin, maytansinoid, methotrexate, mycotoxin, taxol, ricin, bouganin, gelonin, *pseudomonas* exotoxin 38 (PE38), diphtheria toxin (DT), and their analogues, and derivates thereof and combinations thereof. A skilled person would appreciate that the non-limiting examples of cytotoxic agents include all possible variant of said agents, for example the agent auristatin includes for example auristatin E, auristatin F, auristatin PE, and derivates thereof.

While the invention has been described with reference to various exemplary aspects and embodiments, it will be understood by those skilled in the art that various changes may be made and equivalents may be substituted for elements thereof without departing from the scope of the invention. In addition, many modifications may be made to adapt a particular situation or molecule to the teachings of the invention without departing from the essential scope thereof. Therefore, it is intended that the invention not be limited to any particular embodiment contemplated, but that the invention will include all embodiments falling within the scope of the appended claims.

BRIEF DESCRIPTION OF THE FIGURES

FIGS. 1A-1QQ are a listing of the amino acid sequences of examples of IL-17A binding polypeptides of the present disclosure (SEQ ID NO:1-1222), a control polypeptide (SEQ ID NO:1223), the albumin binding polypeptides PP013 (SEQ ID NO:1224) and PEP07843 (SEQ ID NO:1225) as well as the amino acid sequences of human IL-17A (SEQ ID NO:1226), murine IL-17A (SEQ ID NO:1227), cynomolgus monkey IL-17A (SEQ ID NO:1229), rhesus monkey IL-17A (SEQ ID NO:1230) and human IL-17F (SEQ ID NO:1228) used for selection, screening and/or characterization for illustration of the invention. In the IL-17A binding polypeptides of the present disclosure, the deduced IL-17A binding motifs (BMs) extend from residue 8 to residue 36 in each sequence. The amino acid sequences of the 49 amino acid residues long polypeptides (BMod) predicted to constitute the complete three-helix bundle within each of these Z variants extend from residue 7 to residue 55.

FIG. 2 shows inhibition of IL-17A induced IL-6 production assessed by the NHDF assay described in Example 3. (A) $His_6$-Z06260 (open diamonds), $His_6$-Z06282 (open squares) and $His_6$-Z06455 (open circles) were titrated in a medium containing IL-17A. (B) Z06260-ABD (closed diamonds), $His_6$-Z06282 (open squares), Z06282-ABD (filled squares), $His_6$-Z06455 (open circles) and Z06455-ABD (filled circles) were titrated in a medium containing IL-17A and HSA.

FIG. 6 shows binding of human IL-17A (grey) and cynomolgus IL-17A (black) to (A) ZAZ3363 (SEQ ID NO:1244), (B) ZAZ3364 (SEQ ID NO:1245) and (C) ZAZ3365 (SEQ ID NO:1246), analyzed in a Biacore instrument as described in Example 11. The resulting curves, from which responses from a blank surface were subtracted, correspond to injections of the respective IL-17A protein at concentrations 2.5, 10 and 40 nM.

FIG. 7 shows inhibition of IL-17A induced IL-6 production in the NHDF assay described in Example 14. FIG. 7A shows a superior inhibitory efficacy with the dimeric Z-ABD-Z polypeptide ZAZ3220 (SEQ ID NO:1236, solid black line) compared to the corresponding monomeric Z variant Z10241 (SEQ ID NO:11, dotted black line). FIG. 7B shows an evaluation of different linker lengths between the Z and the ABD moieties in Z-ABD-Z polypeptides comprising the Z variant Z06282 (SEQ ID NO:1206). The Z-ABD-Z polypeptides ZAZ3174 (SEQ ID NO:1233), ZAZ3176 (SEQ ID NO:1235), ZAZ3234 (SEQ ID NO:1238), ZAZ3235 (SEQ ID NO:1239), ZAZ3236 (SEQ ID NO:1240) and ZAZ3237 (SEQ ID NO:1241) with various numbers of $G_4S$ repeats, or minimal linkers, on each side of the ABD were compared.

FIG. 9 shows the pharmacokinetic profiles of the Z-ABD-Z polypeptides (A) ZAZ3220 (SEQ ID NO:1236) and (B) ZAZ3363 (SEQ ID NO:1244), following a single i.v. (black line) or s.c. (gray broken line) administration to SD rats as described in Example 16. The mean serum concentrations versus time is displayed.

FIG. 11 shows the activity of ZAZ3363 (SEQ ID NO:1244) formulated in OAF1 and OAF2, respectively, in comparison to formulation in PBS, and analyzed in the NHDF assay described in Example 18. A) OAF1 (filled circles), PBS (crosses) and OAF1 without ZAZ3363 (open diamonds). B) OAF2 (open triangles), PBS (crosses) and OAF2 without ZAZ3363 (open diamonds).

FIG. 13 shows the evaluation of the complexes $HC_{Ada}$-Z14253 and $LC_{Ada}$-Z14253 in the NHDF assay described in Example 19. (A) Schematic of the complexes $HC_{Ada}$-Z14253 (left) and $LC_{Ada}$-Z14253 (right). (B) Inhibition of IL-17A induced IL-6 production. (C) Inhibition of TNF-induced IL-8 production. (D) Inhibition of TNF and IL-17A-induced IL-8 production. Z04726-ABD is a negative control, included in all three assays.

FIG. 14 shows the pharmacokinetic profiles of the Z-ABD-Z polypeptide ZAZ3363 (SEQ ID NO:1244) in cynomolgus monkeys following i.v. administration of 20 mg/kg (black) or 40 mg/kg (grey) on day 1, 4, 7 and 10 as described in Example 20. Mean plasma concentrations versus time are shown following analysis of (A) the first injection on day 1 and (B) the fourth injection on day 10. Error bars represent standard deviation.

EXAMPLES

Summary

Figure 3:
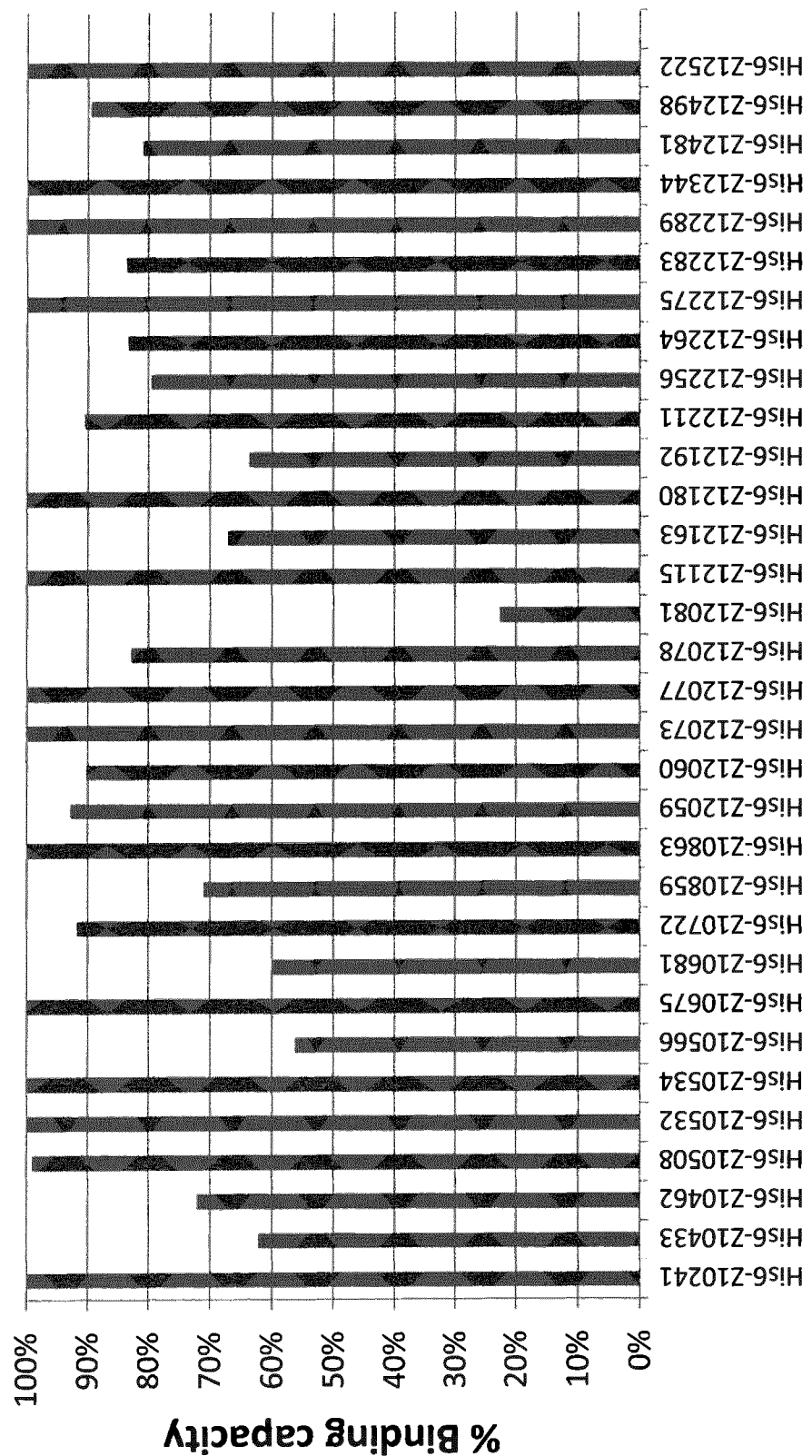
FIG. 3 shows the IL-17A binding capacity of a set of Z variants from the first and second maturation library assayed by ELISA as described in Example 8. The results are displayed as percent binding capacity compared to the IL-17A binding variant Z10241 (SEQ ID NO:11).

The following Examples disclose the development of novel Z variant molecules targeted to interleukin 17A (IL-17A) based on phage display technology. The IL-17A binding polypeptides described herein were sequenced, and their amino acid sequences are listed in FIG. 1 with the sequence identifiers SEQ ID NO:1-1222. The Examples further describe the characterization of IL-17A binding polypeptides and in vitro and in vivo functionality of said polypeptides.

Example 1

Selection and Screening of IL-17A Binding Z Variants

Materials and Methods

Biotinylation of Target Protein:

Human IL-17A (hIL-17A Peprotech cat. no. 200-17; SEQ ID NO:1226) and murine IL-17A (mIL-17A Peprotech cat. no. 210-17; SEQ ID NO:1227) were biotinylated according to the manufacturer's recommendations at room temperature (RT) for 30 min using No-Weigh EZ-Link Sulfo-NHS-LC-Biotin (Thermo Scientific, cat. no. 21327) at a 20× molar excess. Subsequent buffer exchange to phosphate buffered saline (PBS, 10 mM phosphate, 137 mM NaCl, 2.68 mM KCl, pH 7.4) was performed using a dialysis cassette (Slide-a-lyzer 3.5 K, 3500 MWCO, Thermo Scientific, cat. no. 66333) according to the manufacturer's instructions.

Phage Display Selection of IL-17A Binding Z Variants:

A library of random variants of protein Z displayed on bacteriophage, constructed in phagemid pAY02592 essentially as described in Grönwall et al. (2007) J Biotechnol, 128:162-183, was used to select IL-17A binding Z variants. In this library, an albumin binding domain (abbreviated ABD and corresponding to GA3 of protein G from *Streptococcus* strain G148) is used as fusion partner to the Z variants. The library is denoted Zlib006Naive.II and has a size of $1.5 \times 10^{10}$ library members (Z variants). *E. coli* RRIΔM15 cells (Ruther et al., (1982) Nucleic Acids Res 10:5765-5772) from a glycerol stock containing the phagemid library Zlib006Naive.II, were inoculated in 20 l of a defined proline free medium [3 g/l $KH_2PO_4$, 2 g/l $K_2HPO_4$, 0.02 g/l uracil, 6.7 g/l YNB (Difco™ Yeast Nitrogen Base w/o amino acids, Becton Dickinson), 5.5 g/l glucose monohydrate, 0.3 g/l L-alanine, 0.24 g/l L-arginine monohydrochloride, 0.11 g/l L-asparagine monohydrate, 0.1 g/l L-cysteine, 0.3 g/l L-glutamic acid, 0.1 g/l L-glutamine, 0.2 g/l glycine, 0.05 g/l L-histidine, 0.1 g/l L-isoleucine, 0.1 g/l L-leucine, 0.25 g/l L-lysine monohydrochloride, 0.1 g/l L-methionine, 0.2 g/l L-phenylalanine, 0.3 g/l L-serine, 0.2 g/l L-threonine, 0.1 g/l L-tryptophane, 0.05 g/l L-tyrosine, 0.1 g/l L-valine], supplemented with 100 μg/ml ampicillin. The cultivations were grown at 37° C. in a fermenter (Belach Bioteknik, BR20). When the cells reached an optical density at 600 nm ($OD_{600}$) of 0.75, approximately 2.6 l of the cultivation was infected using a 10× molar excess of M13K07 helper phage (New England Biolabs, cat. no. N0315S). The cells were incubated for 30 min, whereupon the fermenter was filled up to 20 l with cultivation medium [2.5 g/l $(NH_4)_2SO_4$; 5.0 g/l Yeast Extract (Merck 1.03753.0500); 25 g/l Peptone (Scharlau 07-119); 2 g/l $K_2HPO_4$; 3 g/l $KH_2PO_4$; 1.25 g/l $Na_3C_6H_5O_7 \cdot 2 H_2O$; 0.1 ml/l Breox FMT30 antifoaming agent] supplemented with 100 μM isopropyl-β-D-1-thiogalactopyranoside (IPTG) for induction of expression and with 50 μg/ml ampicillin, 12.5 μg/ml carbenicillin, 25 μg/ml kanamycin, 35 ml/l of 1.217 M $MgSO_4$ and 10 ml of a trace element solution [129 mM $FeCl_3$, 36.7 mM $ZnSO_4$; 10.6 mM $CuSO_4$; 78.1 mM $MnSO_4$; 94.1 mM $CaCl_2$, dissolved in 1.2 M HCl]. A glucose-limited fed-batch cultivation was started where a 600 g/l glucose solution was fed to the reactor (15 g/h in the start, 40 g/h at the end of the fermentation after 17 h). Through the automatic addition of 25% $NH_4OH$, the pH was controlled at 7. Air was supplemented (10 l/min) and the stirrer was set to keep the dissolved oxygen level above 30%. The cells in the cultivation were removed by tangential flow filtration.

The phage particles were precipitated from the supernatant twice in PEG/NaCl (polyethylene glycol/sodium chloride), filtered and dissolved in PBS and glycerol as described in Grönwall et al., supra. Phage stocks were stored at −80° C. before use.

Selections against biotinylated hIL-17A (b-hIL-17A) or biotinylated mIL-17A (b-mIL-17A) were performed in four cycles divided in six different tracks (Table 2). Phage stock preparation, selection procedure and amplification of phage between selection cycles were performed essentially as described in WO2009/077175 for selection against another target with the following exceptions. Exception 1: PBS supplemented with 3% bovine serum albumin (BSA, Sigma, cat. no. A3059) and 0.1% Tween20 (Acros Organics, cat. no. 233362500) was used as selection buffer. Exception 2: pre-selection was performed in cycles 1-3 by incubation of phage stock with Dynabeads® M-280 Streptavidin (SA beads, Invitrogen, cat. no. 11206D). Exception 3: all tubes and beads used in the selections were pre-blocked with PBS supplemented with 5% BSA and 0.1% Tween20. Exception 4: selections were performed in solution at RT and the time for selection was 200 min in the first cycle and 120 min in the following cycles. Exception 5: this was followed by catching of target-phage complexes on SA beads using 1 mg beads per 6.4 µg b-hIL-17A or b-mIL-17A. Exception 6: E. coli strain XL1-Blue cells (Agilent Technologies, cat. no. 200268) grown in medium supplemented with 10 µg/ml tetracycline (exception 7) were used for infection. Exception 8: tryptone yeast extract plates (15 g/l agar, 10 g/l tryptone water (Merck), 5 g/l yeast extract, 3 g/l NaCl, 2% glucose) supplemented with 0.1 g/l ampicillin and 0.01 g/l tetracycline were used for spreading of bacteria. Exception 9: a 10× excess of M13K07 helper phage compared to bacteria was allowed to infect log phase bacteria.

An overview of the selection strategy, describing an increased stringency in subsequent cycles obtained using a lowered target concentration and an increased number of washes, is shown in Table 2.

in deep-well plates (Nunc, cat. no. 278752). The plates were incubated for 18-24 h at 37° C. Cells were pelleted by centrifugation, re-suspended in 400 µl PBST 0.05% and frozen at −80° C. to release the periplasmic fraction of the cells. Frozen samples were thawed in a water bath and the freeze-thawing procedure was repeated six times. 400 µl PBST 0.05% was added to the thawed samples and cells were pelleted by centrifugation.

The final supernatant of the periplasmic extract contained the Z-variants as fusions to ABD, expressed as AQHDEALE-[Z#####]-VDYV-[ABD]-YVPG (SEQ ID NO:1314) (Grönwall et al., supra). Z##### refers to individual 58 amino acid residue Z variants.

ELISA Screening of Z Variants:

The binding of Z variants to human IL-17A was analyzed in ELISA assays. Half-area 96-well ELISA plates (Costar, cat. no. 3690) were coated at 4° C. overnight with 2 µg/ml of an anti-ABD goat antibody (produced in-house) diluted in coating buffer (50 mM sodium carbonate, pH 9.6; Sigma, cat. no. C3041). The antibody solution was poured off and the wells were washed in water and blocked with 100 µl of PBSC (PBS supplemented with 0.5% casein) for 1 to 3 h at RT. The blocking solution was discarded and 50 µl periplasmic solutions were added to the wells and incubated for 1.5 h at RT under slow agitation. As a blank control, PBST 0.05% was added instead of the periplasmic sample. The supernatants were poured off and the wells were washed 4 times with PBST 0.05%. Next, 50 µl of b-hIL-17A at a concentration of 6.5 nM in PBSC was added to each well. The plates were incubated for 1.5 h at RT followed by washes as described above. Streptavidin conjugated HRP

TABLE 2

Overview of the selection from a primary library

| Cycle | Selection track | Phage stock from library or selection track | Target | Target concentration (nM) | Number of washes | Higher amount of phage into selection track |
|---|---|---|---|---|---|---|
| 1 | 1 | Zlib006Naive.II | hIL-17A | 50 | 2 | — |
| 2 | 1-1 | 1 | hIL-17A | 25 | 4 | Yes |
| 2 | 1-2 | 1 | hIL-17A | 25 | 4 | — |
| 2 | 1-3 | 1 | hIL-17A | 5 | 5 | — |
| 2 | 1-4 | 1 | mIL-17A | 50 | 4 | — |
| 3 | 1-1-1 | 1-1 | hIL-17A | 12.5 | 6 | Yes |
| 3 | 1-2-1 | 1-2 | hIL-17A | 12.5 | 6 | — |
| 3 | 1-3-1 | 1-3 | hIL-17A | 1 | 8 | — |
| 3 | 1-4-1 | 1-4 | hIL-17A | 12.5 | 6 | — |
| 3 | 1-4-2 | 1-4 | mIL-17A | 5 | 8 | — |
| 4 | 1-1-1-1 | 1-1-1 | hIL-17A | 5 | 8 | Yes |
| 4 | 1-2-1-1 | 1-2-1 | hIL-17A | 5 | 8 | — |
| 4 | 1-3-1-1 | 1-3-1 | hIL-17A | 0.25 | 12 | — |
| 4 | 1-3-1-2 | 1-3-1 | hIL-17A | 0.05 | 15 | — |
| 4 | 1-4-1-1 | 1-4-1 | mIL-17A | 5 | 8 | — |
| 4 | 1-4-2-1 | 1-4-2 | hIL-17A | 0.5 | 12 | — |

Track 1 was divided in the second to the fourth cycles, resulting in a total of four tracks (1-1 to 1-4) in cycle 2, five tracks (1-1-1 to 1-4-2) in cycle 3 and six tracks (1-1-1-1 to 1-4-2-1) in cycle 4. The number of phage particles used for selections was about 2000 times the number of eluted phage particles in the previous cycle, but a higher amount was used in selection tracks 1-1, 1-1-1 and 1-1-1-1.

Washes were performed for 1 min using PBST 0.1% (PBS supplemented with 0.1% Tween-20), and elution was carried out as described in WO2009/077175.

Production of Z Variants for ELISA:

The Z variants were produced by inoculating single colonies from the selections into 1 ml TSB-YE medium supplemented with 100 µg/ml ampicillin and 0.1 mM IPTG (Thermo Scientific, cat. no. N100) diluted 1:30,000 in PBSC, was added to the wells and the plates were incubated for 1 h. After washing as described above, 50 µl ImmunoPure TMB substrate (Thermo Scientific, cat. no. 34021) was added to the wells and the plates were treated according to the manufacturer's recommendations. The absorbance at 450 nm was measured using a Victor$^3$ multi-well plate reader (Perkin Elmer).

Sequencing:

In parallel with the ELISA screening, all clones were picked for sequencing. PCR fragments were amplified from single colonies, sequenced and analyzed essentially as described in WO2009/077175.

Results

Phage Display Selection of IL-17A Binding Z Variants:

Individual clones were obtained after four cycles of phage display selections against b-hIL-17A and b-mIL-17A.

ELISA Screening of Z Variants:

The clones obtained after four cycles of selection were expanded in 96-well plates and screened for hIL-17A binding activity in ELISA. 42 Z variants were found to give a response of 4× the blank control or higher (0.43-3.2 AU) against hIL-17A at a concentration of 6.5 nM. No response was obtained for the blank control.

Sequencing:

Sequencing was performed for clones obtained after four cycles of selection. Each variant was given a unique identification number #####, and individual variants are referred to as Z#####. The amino acid sequences of the 58 amino acid residues long Z variants are listed in FIG. 1 and in the sequence listing as SEQ ID NO: 1200-1216. The deduced IL-17A binding motifs extend from residue 8 to residue 36 in each sequence. The amino acid sequences of the 49 amino acid residues long polypeptides predicted to constitute the complete three-helix bundle within each of these Z variants extend from residue 7 to residue 55.

Example 2

Production of Monomeric IL-17A Binding Z Variants

This Example describes the general procedure for subcloning and production of His-tagged Z variants and Z variants in fusion with ABD, which are used throughout in characterization experiments below.

Materials and Methods

Subcloning of Z Variants with a His-Tag:

The DNA of respective Z variant was amplified from the library vector pAY02592. A subcloning strategy for construction of monomeric Z variant molecules with N-terminal $His_6$ tag was applied using standard molecular biology techniques (essentially as described in WO2009/077175 for Z variants binding another target). The Z gene fragments were subcloned into the expression vector pAY01448 resulting in the encoded sequence MGSSHHHHHHLQ-[Z#####]-VD (SEQ ID NO:1315).

Subcloning of Z Variants in Fusion with ABD:

The DNA of respective Z variant was amplified from the library vector pAY02592. A PCR was performed using suitable primer pairs and the resulting gene fragments were cleaved with restriction enzymes PstI and AccI and ligated into the expression vector pAY03362 digested with the same enzymes, resulting in an ABD fusion protein, wherein the ABD variant is PP013 (SEQ ID NO:1224). The constructs encoded by the expression vectors were MGSSLQ-[Z#####]-VDSS-PP013 (SEQ ID NO:1316).

Cultivation:

E. coli BL21(DE3) cells (Novagen) were transformed with plasmids containing the gene fragment of each respective IL-17A binding Z variant and cultivated at 37° C. in 800 or 1000 ml of TSB-YE medium supplemented with 50 µg/ml kanamycin. In order to induce protein expression, IPTG was added to a final concentration of 0.2 mM at $OD_{600}=2$ and the cultivation was incubated at 37° C. for another 5 h. The cells were harvested by centrifugation.

Purification of IL-17A Binding Z Variants with a $His_6$-Tag:

Approximately 2-5 g of each cell pellet was re-suspended in 30 ml of binding buffer (20 mM sodium phosphate, 0.5 M NaCl, 20 mM imidazole, pH 7.4) supplemented with Benzonase® (Merck) to a concentration of 15 U/ml. After cell disruption, cell debris was removed by centrifugation and each supernatant was applied on a 1 ml His GraviTrap IMAC column (GE Healthcare). Contaminants were removed by washing with wash buffer (20 mM sodium phosphate, 0.5 M NaCl, 60 mM imidazole, pH 7.4 and the IL-17A binding Z variants were subsequently eluted with elution buffer (20 mM sodium phosphate, 0.5 M NaCl, 500 mM imidazole, pH 7.4).

Purification of IL-17A Binding Z Variants in Fusion with ABD:

Approximately 1-2 g of each cell pellet was re-suspended in 30 ml TST-buffer (25 mM Tris-HCl, 1 mM EDTA, 200 mM NaCl, 0.05% Tween20, pH 8.0) supplemented with Benzonase® (Merck). After cell disruption by sonication and clarification by centrifugation, each supernatant was applied on a gravity flow column with 1 ml agarose immobilized with an anti-ABD ligand (produced in-house). After washing with TST-buffer and 5 mM $NH_4Ac$ pH 5.5 buffer, the ABD fused Z variants were eluted with 0.1 M HAc. To fractions eluted in the anti-ABD agarose affinity chromatography purification step, acetonitrile (ACN) was added to a final concentration of 10% and the sample was loaded on 1 ml Resource 15RPC column (GE Healthcare), previously equilibrated with RPC solvent A (0.1% TFA, 10% ACN, 90% water). After column wash with RPC solvent A, bound proteins were eluted with a linear gradient 0-50% RPC solvent B (0.1% TFA, 80% ACN, 20% water) for 20 ml. Fractions containing pure ABD-fused Z variants were identified by SDS-PAGE analysis and pooled. After the RPC purification, the buffer of the pool was exchanged to PBS (2.68 mM KCl, 137 mM NaCl, 1.47 mM $KH_2PO_4$, 8.1 mM $Na_2HPO_4$, pH 7.4) using PD-10 columns (GE Healthcare). Finally, the ABD fused Z variants were purified on 1 ml EndoTrap® red columns (Hyglos) to ensure low endotoxin content.

Protein concentrations were determined by measuring the absorbance at 280 nm, using a NanoDrop® ND-1000 spectrophotometer and the extinction coefficient of the respective protein. The purity was analyzed by SDS-PAGE stained with Coomassie Blue and the identity of each purified Z variant was confirmed using LC/MS analysis.

Results

Cultivation and Purification:

The IL-17A binding Z variants with a $His_6$-tag as well as the Z variants fused at their C-terminus to ABD, were expressed as soluble gene products in E. coli. The amount of purified protein from approximately 1-5 g bacterial pellet was determined spectrophotometrically by measuring the absorbance at 280 nm and ranged from approximately 5 mg to 20 mg for the different IL-17A binding Z variants. SDS-PAGE analysis of each final protein preparation showed that these predominantly contained the IL-17A binding Z variant. The correct identity and molecular weight of each Z variant were confirmed by HPLC-MS analysis.

Example 3

Assessment of Blocking Ability of Primary IL-17A Binding Z Variants

Normal human dermal fibroblasts (NHDF) produce IL-6 upon stimulation with IL-17A (Chang and Dong 2007, Cell Research 17:435-440) and the amount of released IL-6 to the supernatant is correlated to the concentration of added IL-17A. Thus, blocking of IL-17A leads to a reduction of IL-6 in the supernatant that can be quantified. In this Example, the assay was used to evaluate the blocking ability of IL-17A binding Z variants Z06260 (SEQ ID NO:1200), Z06282 (SEQ ID NO:1206) and Z06455 (SEQ ID NO:1214), alone or in fusion with ABD (PP013, SEQ ID NO:1224).

Materials and Methods

NHDF Assay with $His_6$-Tagged Z-Variants:

NHDF cells (Lonza, cat. no. CC-2511) were cultured in fibroblast basal medium (Lonza, cat. no. CC-3132) supplied with growth promoting factors (Lonza, cat. no. CC-5034). On the day before the experiment, $10^5$ cells were seeded in 100 µl per well into 96-well culture plates (Greiner, cat.no. 655180). On the day of the experiment, dilutions of the IL-17A specific Z variants $His_6$-Z06260, $His_6$-Z06282 and $His_6$-Z06455 were prepared in a separate 96-well plate. The Z variants were titrated in three-fold steps from 3130 nM to 0.2 nM in medium containing 0.031 nM hIL-17A. A standard curve of hIL-17A was also prepared (0.002-31 nM) as well as controls containing medium with 0.031 nM hIL-17A or medium alone. The medium in the plate with the overnight cultured NHDF cells was discarded. Test samples, standard curve samples and controls were transferred to the cell-containing plate. The NHDF cells were stimulated for 18-24 h at 37° C. and the IL-6 content in the supernatants was subsequently quantified using the IL-6 specific ELISA described below.

NHDF Assay with $His_6$-Tagged and ABD Fused Z Variants:

NHDF cells were prepared as described above. On the day of the experiment, dilutions of the IL-17A specific Z variant constructs $His_6$-Z06282, $His_6$-Z06455, Z06260-ABD, Z06282-ABD and Z06455-ABD were prepared in a separate 96-well plate. The Z variant constructs were titrated in four-fold steps from 780 nM to 0.2 nM in medium containing 0.031 nM IL-17A and 8 µM HSA. Preparation of a standard IL-17A curve and controls, as well as downstream analysis, was performed as described above.

IL-6 ELISA:

96-well half area plates (Costar, cat. no. 3690) were coated with the anti-IL-6 monoclonal antibody MAB206 (R&D systems) at a concentration of 4 µg/ml in PBS (50 µl/well) and incubated overnight at 4° C. On the next day, the plates were rinsed twice in tap water and blocked with PBS+2% BSA (Sigma) for 2 h. An IL-6 standard (R&D systems, cat. no. 206-IL-50), titrated in a 2-fold dilution series (0.2-50 ng/ml) and supernatants from the cell assay plate were added to the coated ELISA plates (50 µl/well) and incubated for 1.5 h at RT. The plates were washed 4 times in an automated ELISA washer and 0.25 µg/ml (50 µl/well) of biotinylated anti-IL-6 polyclonal antibody (R&D systems, BAF206) was added. After incubation for 1 h, the plate was washed and 50 µl of streptavidin-HRP (Thermo Fisher, cat. no. N100) diluted 8000 times was added to each well. After one additional hour of incubation and subsequent washing, the plate was developed with 50 µl TMB (Thermo Fisher, cat. no. 34021) per well and the reactions were stopped with 50 µl 2M $H_2SO_4$. The absorbance at 450 nm was measured in a 96-well plate reader (Victor$^3$) and the concentration of IL-6 in each sample was calculated. The results are presented as the percentage of maximum IL-6 production, calculated as:

$$100 - [ABS_{IL\text{-}17A\ blocker} - ABS_{background}] / (ABS_{Max\ IL\text{-}6\ prod} - ABS_{background})] \times 100$$

Results

Results from the first NHDF assay showed that all three Z variants $His_6$-Z06260, $His_6$-Z06282 and $His_6$-Z06455 blocked IL-17A induced IL-6 production in a dose dependent manner (FIG. 2A). The IC50 values were approximately 40-140 nM.

The NHDF assay was repeated with the same Z variants fused to ABD as well as inclusion of HSA in the assay to ascertain retained binding to the antigen when mimicking in vivo conditions. In vivo, ABD will bind to albumin and convey longer circulation half-life. The results showed that all three binders in fusion with ABD blocked IL-17A induced IL-6 production equally well or better than the $His_6$-tagged Z variants (FIG. 2B). The IC50 values from the second assay are summarized in Table 3.

TABLE 3

IC50 values for primary Z-variants blocking IL-17A induced IL-6 production in the presence of HSA

| Analyte | SEQ ID NO of Z variant | IC50 (nM) |
|---|---|---|
| Z06260-ABD | 1200 | 8 |
| $His_6$-Z06282 | 1206 | 16 |
| Z06282-ABD | 1206 | 15 |
| $His_6$-Z06455 | 1214 | 67 |
| Z06455-ABD | 1214 | 15 |

Example 4

Design and Construction of a First Maturated Library of IL-17A Binding Z Variants In this Example, a maturated library was designed and constructed. The library was used for selection of further IL-17A binding Z variants. Selections from maturated libraries are usually expected to result in binders with increased affinity (Orlova et al., (2006) Cancer Res 66(8):4339-48). In this study, randomized single stranded linkers were generated using split-pool DNA synthesis, enabling incorporation of defined codons in desired positions in the synthesis.

Materials and Methods

Library Design:

The library was based on the sequences of the IL-17A binding Z variants identified as described in Example 1. In the new library, 13 variable positions in the Z molecule scaffold were biased towards certain amino acid residues, according to a strategy based on the Z variant sequences defined in SEQ ID NO:1200-1216. A DNA linker was generated using split-pool synthesis containing the following 147 bp sequence ordered from DNA 2.0 (Menlo Park, Calif., USA): 5'-AA ATA AAT CTC GAG GTA GAT GCC AAA TAC GCC AAA GAA NNN NNN NNN GCG NNN NNN GAG ATC NNN NNN TTA CCT AAC TTA ACC NNN NNN CAA NNN NNN GCC TTC ATC NNN AAA TTA NNN GAT GAC CCA AGC CAG AGC TCA TTA TTT A-3' (SEQ ID NO:1248, randomized codons are denoted NNN), comprising a coding sequence for a partially randomized helix 1 and 2 in the corresponding amino acid sequence, flanked by restriction sites for XhoI and SacI. The theoretical distributions of amino acid residues in the new library including 13 variable Z positions (9, 10, 11, 13, 14, 17, 18, 24, 25, 27, 28, 32 and 35) in the Z molecule scaffold are given in Table 4. The resulting theoretical library size is $6.1 \times 10^9$ variants.

TABLE 4

Library design, first maturation

| Amino acid position in the Z variant molecule | Randomization (amino acid abbreviations) | No of amino acids | Proportion |
|---|---|---|---|
| 9  | A, H, M, W, Y             | 5 | 1/5 |
| 10 | A, D (60%), G, L, N       | 5 | 1/10, 6/10 (D) |
| 11 | D, E, F, N, Q R, Y        | 7 | 1/7 |
| 13 | A, E, Q, W                | 4 | 1/4 |
| 14 | F, I, L, M, V, W          | 6 | 1/6 |
| 17 | A, F, Q, W                | 4 | 1/4 |
| 18 | A, D, E, L, M, S, T       | 7 | 1/7 |
| 24 | A, H, R, T, W, Y          | 6 | 1/6 |
| 25 | A, D, H, R, V             | 5 | 1/5 |
| 27 | A, G, Q, R, S, W          | 6 | 1/6 |
| 28 | F, H, K, N, R, S, T, V, Y | 9 | 1/9 |
| 32 | A, G, H, I, Q, R, S, V    | 8 | 1/8 |
| 35 | I, L, N, R                | 4 | 1/4 |

Library Construction:

The library was amplified using AmpliTaq Gold polymerase (Applied Biosystems, cat. no. 4311816) during 12 cycles of PCR, and pooled products were purified with QIAquick PCR Purification Kit (QIAGEN, cat. no. 28106) according to the supplier's recommendations. The purified pool of randomized library fragments was digested with restriction enzymes XhoI and SacI-HF (New England Biolabs, cat. no. R0146L and cat. no. R3156M, respectively) and concentrated using the QIAquick PCR Purification Kit. Subsequently, the product was subjected to gel electrophoresis using a preparative 2.5% agarose gel (Nuisieve GTC agarose, Cambrex, Invitrogen) and purified from said gel using QIAGEN Gel Extraction Kit (QIAGEN, cat. no. 28706) according to the supplier's recommendations.

The phagemid vector pAY02592 (essentially as pAffi1 described in Grönwall et al., supra) was restricted with the same enzymes, purified using phenol/chloroform extraction and ethanol precipitation. The restricted fragments and the restricted vector were ligated in a molar ratio of 5:1 with T4 DNA ligase (Fermentas, cat. no. EL0011) for 2 h at RT, followed by overnight incubation at 4° C. The ligated DNA was recovered by phenol/chloroform extraction and ethanol precipitation, followed by dissolution in 10 mM Tris-HCl, pH 8.5. Thus, the resulting library in vector pAY02592 encoded Z variants each fused to an albumin binding domain (ABD) derived from streptococcal Protein G.

The ligation reactions (approximately 160 ng DNA/transformation) were electroporated into electrocompetent E. coli ER2738 cells (Lucigen, Middleton, Wis., USA, 50 μl). Immediately after electroporation, approximately 1 ml of recovery medium (supplied with E. coli ER2738 cells) was added. The transformed cells were incubated at 37° C. for 60 min. Samples were taken for titration and for determination of the number of transformants. The cells were thereafter pooled and cultivated overnight at 37° C. in 1 l of TSB-YE medium, supplemented with 2% glucose, 10 μg/ml tetracycline and 100 μg/ml ampicillin. The cells were pelleted for 15 min at 4,000 g and resuspended in a PBS/glycerol solution (approximately 40% glycerol). The cells were aliquoted and stored at −80° C. Clones from the library of Z variants were sequenced in order to verify the content and to evaluate the outcome of the constructed library vis-à-vis the library design. Sequencing was performed as described in Example 1 and the amino acid distribution was verified.

Preparation of Phage Stock:

Phage stock containing the phagemid library was prepared in a 20 l fermenter (Belach Bioteknik). Cells from a glycerol stock containing the phagemid library were inoculated in 10 l of TSB-YE supplemented with 1 g/l glucose, 100 mg/l ampicillin and 10 mg/l tetracycline. When the cells reached an optical density at 600 nm ($OD_{600}$) of 0.52, approximately 1.7 l of the cultivation was infected using a 5× molar excess of M13K07 helper phage. The cells were incubated for 30 min, whereupon the fermenter was filled up to 10 l with complex fermentation medium [2.5 g/l $(NH_4)_2SO_4$, 5.0 g/l yeast extract; 30 g/l tryptone, 2 g/l $K_2HPO_4$; 3 g/l $KH_2PO_4$, 1.25 g/l, $Na_3C_6H_5O_7.2 H_2O$; Breox FMT30 antifoaming agent 0.1 ml/l]. The following components were added: 10 ml carbenicillin 25 mg/ml, 5 ml kanamycin 50 mg/ml, 1 ml 1 M IPTG; 17.5 ml/l 1.217 M $MgSO_4$ and 5 ml of a trace element solution [129 mM $FeCl_3$; 36.7 mM $ZnSO_4$; 10.6 mM $CuSO_4$; 78.1 mM $MnSO_4$; 94.1 mM $CaCl_2$, dissolved in 1.2 M HCl]. A glucose limited fed-batch cultivation was started where a 600 g/l glucose solution was fed to the reactor (3.5 g/h at the start, 37.5 g/h after 20 h continuing until the end of the cultivation). Through the automatic addition of 25% $NH_4OH$, the pH was controlled at pH 7. Air was supplemented (5 l/min) and the stirrer was set at 500 rpm. After 24 h of fed-batch cultivation the $OD_{600}$ was 19.4. The cells in the cultivation were pelleted by centrifugation at 15,900 g. The phage particles were precipitated from the supernatant twice in PEG/NaCl, filtered and dissolved in PBS and glycerol as described in Example 1. Phage stocks were stored at −80° C. until use in selection.

Results

Library Construction:

The new library was designed based on a set of IL-17A binding Z variants with verified binding properties (Example 1 and 3). The theoretical size of the designed library was $6.1 \times 10^9$ Z variants. The actual size of the library, determined by titration after transformation to E. coli ER2738 cells, was $4.5 \times 10^9$ transformants.

The library quality was tested by sequencing of 96 transformants and by comparing their actual sequences with the theoretical design. The contents of the actual library compared to the designed library were shown to be satisfactory. A maturated library of potential binders to IL-17A was thus successfully constructed.

Example 5

Selection, Screening and Characterization of Z Variants from the First Maturated Library Materials and Methods Phage Display Selection of IL-17A Binding Z Variants:

The target proteins hIL-17A and mIL-17A were biotinylated as described in Example 1. Phage display selections, using the new library of Z variant molecules constructed as described in Example 4, were performed in four cycles against hIL-17A and mIL-17A essentially as described in Example 1, with the following exceptions. Exception 1: PBST 0.1% was used as selection buffer. At selection, fetal calf serum (FCS, Gibco, cat. no.10108-165) and human serum albumin (HSA, Albucult, Novozymes, cat. no. 230-005) were added to the selection buffer to a final concentration of 10% and 1.5 μM, respectively. Exception 2: a pre-selection step was performed in cycle 1 by incubating the phage stock with SA beads. Exception 3: all tubes and beads used in the selection were pre-blocked with PBS supplemented with 3% BSA and 0.1% Tween20. Exception 4: the time for selection was 140, 70, 60 and 50 min in cycles 1, 2, 3 and 4, respectively.

An overview of the selection strategy, describing an increased stringency in subsequent cycles obtained by using a lowered target concentration and an increased number of washes, is shown in Table 5.

Amplification of Phage Particles:

Amplification of phage particles between selection cycle 1 and 2 was performed essentially as described in Example 1, with the following three exceptions. Exception 1: *E. coli* ER2738 was used for phage amplification. Exception 2: M13K07 helper phage were used in 5× excess. Exception 3: the amplification of phage particles between the selection

TABLE 5

Overview of the selection from the first maturated library

| Cycle | Selection track | Phage stock from library or selection track | Target | Target conc. (nM) | Number of 1 min washes | Number of 10 min washes | Number of overnight washes | Elution at |
|---|---|---|---|---|---|---|---|---|
| 1 | 1 | Zlib006IL-17A.I | hIL-17A | 25 | 2 | — | — | pH 5.5 |
| 1 | 2 | Zlib006IL-17A.I | hIL-17A | 12.5 | 3 | — | — | pH 2.2 |
| 1 | 3 | Zlib006IL-17A.I | hIL-17A | 25 | 2 | — | — | pH 2.2 |
| 2 | 1-1 | 1 | hIL-17A | 12.5 | 6 | — | — | pH 5.5 |
| 2 | 2-1 | 2 | hIL-17A | 2.5 | 10 | — | — | pH 2.2 |
| 2 | 2-2 | 2 | hIL-17A | 5 | 6 | — | — | pH 2.2 |
| 2 | 3-1 | 3 | hIL-17A | 7.5 | 10 | — | — | pH 2.2 |
| 2 | 3-2 | 3 | hIL-17A | 12.5 | 6 | — | — | pH 2.2 |
| 2 | 3-3 | 3 | mIL-17A | 12.5 | 6 | — | — | pH 2.2 |
| 3 | 1-1-1 | 1-1 | hIL-17A | 2.5 | 10 | — | — | pH 5.5 |
| 3 | 2-1-1 | 2-1 | hIL-17A | 0.05 | 15 | 1 | — | pH 2.2 |
| 3 | 2-2-1 | 2-2 | hIL-17A | 0.5 | 15 | 1 | — | pH 2.2 |
| 3 | 3-1-1 | 3-1 | hIL-17A | 0.75 | 15 | 1 | — | pH 2.2 |
| 3 | 3-2-1 | 3-2 | hIL-17A | 2.5 | 10 | — | — | pH 2.2 |
| 3 | 3-3-1 | 3-3 | hIL-17A | 5 | 10 | — | — | pH 2.2 |
| 4 | 1-1-1-1a | 1-1-1 | hIL-17A | 0.05 | 20 | — | — | pH 5.5 |
| 4 | 1-1-1-1b | 1-1-1 | hIL-17A | 0.05 | 20 | — | 1 | pH 5.5 |
| 4 | 1-1-1-2a | 1-1-1 | hIL-17A | 1 | 12 | — | — | pH 5.5 |
| 4 | 1-1-1-2b | 1-1-1 | hIL-17A | 1 | 12 | — | 1 | pH 5.5 |
| 4 | 2-1-1-1a | 2-1-1 | hIL-17A | 0.0025 | 30 | — | — | pH 2.2 |
| 4 | 2-1-1-1b | 2-1-1 | hIL-17A | 0.0025 | 30 | — | 1 | pH 2.2 |
| 4 | 2-1-1-2a | 2-1-1 | hIL-17A | 0.025 | 20 | — | — | pH 2.2 |
| 4 | 2-1-1-2b | 2-1-1 | hIL-17A | 0.025 | 20 | — | 1 | pH 2.2 |
| 4 | 2-2-1-1a | 2-2-1 | hIL-17A | 0.005 | 30 | — | — | pH 2.2 |
| 4 | 2-2-1-1b | 2-2-1 | hIL-17A | 0.005 | 30 | — | 1 | pH 2.2 |
| 4 | 2-2-1-2a | 2-2-1 | hIL-17A | 0.05 | 20 | — | — | pH 2.2 |
| 4 | 2-2-1-2b | 2-2-1 | hIL-17A | 0.05 | 20 | — | 1 | pH 2.2 |
| 4 | 3-1-1-1a | 3-1-1 | hIL-17A | 0.025 | 30 | — | — | pH 2.2 |
| 4 | 3-1-1-1b | 3-1-1 | hIL-17A | 0.025 | 30 | — | 1 | pH 2.2 |
| 4 | 3-1-1-2a | 3-1-1 | hIL-17A | 0.25 | 20 | — | — | pH 2.2 |
| 4 | 3-1-1-2b | 3-1-1 | hIL-17A | 0.25 | 20 | — | 1 | pH 2.2 |
| 4 | 3-2-1-1a | 3-2-1 | hIL-17A | 0.05 | 20 | — | — | pH 2.2 |
| 4 | 3-2-1-1b | 3-2-1 | hIL-17A | 0.05 | 20 | — | 1 | pH 2.2 |
| 4 | 3-2-1-2a | 3-2-1 | hIL-17A | 1 | 12 | — | — | pH 2.2 |
| 4 | 3-2-1-2b | 3-2-1 | hIL-17A | 1 | 12 | — | 1 | pH 2.2 |
| 4 | 3-3-1-1a | 3-3-1 | mIL-17A | 0.05 | 20 | — | — | pH 2.2 |
| 4 | 3-3-1-1b | 3-3-1 | mIL-17A | 0.05 | 20 | — | 1 | pH 2.2 |
| 4 | 3-3-1-2a | 3-3-1 | mIL-17A | 1 | 15 | — | — | pH 2.2 |
| 4 | 3-3-1-2b | 3-3-1 | mIL-17A | 1 | 15 | — | 1 | pH 2.2 |

Tracks 1-3 in cycle 1 were split in the second to fourth cycles, resulting in a total of six tracks (1-1 to 3-3) in cycle 2, six tracks (1-1-1 to 3-3-1) in cycle 3 and 24 tracks (1-1-1-1a to 3-3-1-2b) in cycle 4. Washes were performed using PBST 0.1% for 1 min. However, for track 1-3 in cycle 3, one of the washes lasted for 10 min.

After the last wash in cycle 4, the target-phage complexes on SA beads from all tracks were divided in two equal parts. Bound phage particles from the first part were immediately eluted, while the second part was subjected to an overnight wash before elution of phage particles. The bound phage particles were eluted using two different procedures: 1) with glycine-HCl, pH 2.2, as in Example 1, or 2) 500 µl of 100 mM sodium phosphate, 150 mM sodium chloride, pH 5.5 and neutralization with 500 µl PBS.

cycles 2 and 4 was performed as follows: after infection of log phase *E. coli* ER2738 with phage particles, TSB supplemented with 2% glucose, 10 µg/ml tetracycline and 100 µg/ml ampicillin was added and followed by incubation with rotation for 30 min at 37° C. Next, the bacteria were infected with M13K07 helper phage. The infected bacteria were pelleted by centrifugation, re-suspended in TSB-YE medium supplemented with 100 µM IPTG, 25 µg/ml kanamycin and 100 µg/ml ampicillin, and grown overnight at 30° C. The overnight cultures were centrifuged, and phage particles in the supernatant were precipitated twice with PEG/NaCl buffer. Lastly, phages were re-suspended in selection buffer before entering the next selection cycle.

In the final selection cycle, log phase bacteria were infected with eluate and diluted before spreading onto TBAB plates (30 g/l tryptose blood agar base, Oxoid cat. no.

CM0233B) supplemented with 0.2 g/l ampicillin in order to form single colonies to be used in ELISA screening.

Sequencing of Potential Binders:

Individual clones from the different selection tracks were picked for sequencing. Amplification of gene fragments and sequence analysis of gene fragments were performed essentially as described in Example 1.

ELISA Screening of Z Variants:

Single colonies containing Z variants (expressed as Z variant ABD fusion proteins as described in Example 1) were randomly picked from the selected clones of the maturated library, and grown in cultivations essentially as described in Example 1. Preparation of the periplasmic supernatants and ELISA screenings were also performed essentially as described in Example 1 with the following two exceptions. Exception 1: biotinylated hIL-17A was used at a concentration of 0.4 nM. Exception 2: the periplasmic fraction of Z variant Z06282 (SEQ ID NO:1206) from the primary selection was used as a positive control.

EC50 Analysis of Z Variants:

A selection of IL-17A binding Z variants was subjected to an analysis of response against a dilution series of b-hIL-17A using ELISA as described above. Biotinylated target protein was added at a concentration of 6 nM and diluted stepwise 1:3 down to 8 µM. As a background control, the Z variants were also assayed with no target protein added. Periplasm samples containing the primary IL-17A binder Z06282 (SEQ ID NO:1206) were included as a positive control. Data were analyzed using GraphPad Prism 5 and non-linear regression, and EC50 values (the half maximal effective concentration) were calculated.

Results

Phage Display Selection of Maturated IL-17A Binding Z Variants:

Selection was performed in a total of 24 parallel tracks containing four cycles each. The different selection tracks differed in target concentration, target species origin (human IL-17A or murine IL-17A), selection time, wash conditions and the pH of the elution buffer. Clones originating from the selection tracks using only human IL-17 and elution at pH 2.2 were shown to have the best performance in ELISA screen.

Sequencing:

Randomly picked clones were sequenced. Each individual Z variant was given an identification number, Z#####, as described in Example 1. In total, 932 new unique Z variant molecules were identified. For the 494 best performing variants in the ELISA screen below, the amino acid sequences of the 58 amino acid residues long Z variants are listed in FIG. 1 as SEQ ID NO:1-3, SEQ ID NO:11-16, SEQ ID NO:28-31, SEQ ID NO:36-63 and SEQ ID NO:67-519. The deduced IL-17A binding motifs extend from residue 8 to residue 36 in each sequence. The amino acid sequences of the 49 amino acid residues long polypeptides predicted to constitute the complete three-helix bundle within each of these Z variants extend from residue 7 to residue 55.

ELISA Screening of Z Variants:

Clones obtained after four selection cycles were produced in 96-well plates and screened for human IL-17A binding activity using ELISA. All randomly picked clones were analyzed. 494 of the 932 unique Z variants were found to give a response of 2× the blank control or higher (0.15-2.0 AU) against hIL-17A at a concentration of 0.4 nM. Positive signals were shown for clones originating from all selection tracks. The blank controls had absorbances of 0.055-0.075 AU.

EC50 Analysis of Z Variants:

A subset of Z variants was selected based on the result of the ELISA screening experiment described above (absorbance over 1.25 AU) or based on variation in amino acid sequence, and subjected to a target titration in ELISA format. Periplasm samples were incubated with a serial dilution of b-hIL-17A ranging from 6 nM to 8 µM. A periplasm sample containing Z06282 (SEQ ID NO:1206) identified in the primary selection was included as a positive control. Obtained values were analyzed and the respective EC50 values were calculated (Table 6).

TABLE 6

Calculated EC50 values from ELISA titration analysis

| Z variant | SEQ ID NO | EC50 (M) |
| --- | --- | --- |
| Z10210 | 36 | $1.1 \times 10^{-9}$ |
| Z10241 | 11 | $3.4 \times 10^{-10}$ |
| Z10255 | 37 | $4.6 \times 10^{-10}$ |
| Z10257 | 38 | $6.7 \times 10^{-10}$ |
| Z10433 | 28 | $9.4 \times 10^{-10}$ |
| Z10459 | 39 | $4.7 \times 10^{-10}$ |
| Z10462 | 12 | $3.4 \times 10^{-10}$ |
| Z10465 | 40 | $5.0 \times 10^{-10}$ |
| Z10470 | 41 | $4.7 \times 10^{-10}$ |
| Z10483 | 42 | $4.0 \times 10^{-10}$ |
| Z10508 | 2 | $3.8 \times 10^{-10}$ |
| Z10529 | 43 | $6.4 \times 10^{-10}$ |
| Z10532 | 1 | $3.6 \times 10^{-10}$ |
| Z10534 | 13 | $4.1 \times 10^{-10}$ |
| Z10550 | 44 | $7.9 \times 10^{-10}$ |
| Z10565 | 45 | $3.8 \times 10^{-10}$ |
| Z10566 | 14 | $5.5 \times 10^{-10}$ |
| Z10675 | 15 | $3.6 \times 10^{-10}$ |
| Z10676 | 46 | $4.0 \times 10^{-10}$ |
| Z10690 | 47 | $5.9 \times 10^{-10}$ |
| Z10703 | 48 | $7.5 \times 10^{-10}$ |
| Z10708 | 49 | $4.1 \times 10^{-10}$ |
| Z10710 | 50 | $5.4 \times 10^{-10}$ |
| Z10718 | 16 | $5.1 \times 10^{-10}$ |
| Z10728 | 51 | $5.3 \times 10^{-10}$ |
| Z10745 | 52 | $6.8 \times 10^{-10}$ |
| Z10756 | 53 | $6.4 \times 10^{-10}$ |
| Z10759 | 54 | $6.7 \times 10^{-10}$ |
| Z10775 | 55 | $5.1 \times 10^{-10}$ |
| Z10778 | 56 | $4.7 \times 10^{-10}$ |
| Z10779 | 57 | $5.7 \times 10^{-10}$ |
| Z10800 | 58 | $6.4 \times 10^{-10}$ |
| Z10807 | 59 | $6.0 \times 10^{-10}$ |
| Z10844 | 60 | $7.5 \times 10^{-10}$ |
| Z10857 | 61 | $4.5 \times 10^{-10}$ |
| Z10858 | 62 | $5.2 \times 10^{-10}$ |
| Z10859 | 31 | $6.9 \times 10^{-10}$ |
| Z10863 | 3 | $4.5 \times 10^{-10}$ |
| Z10914 | 63 | $5.1 \times 10^{-10}$ |
| Z06282 | 1206 | $5.0 \times 10^{-9}$ |

Example 6

Design and Construction of a Second Maturated Library of IL-17A Binding Z Variants In this Example, a second maturated library was constructed essentially as described in Example 4. The library was used for selections of additional IL-17A binding Z variants.

Materials and Methods

Library Design:

The library was based on the sequences of IL-17A binding Z variants selected and characterized in Example 5. In the new library, the 13 positions in the Z molecule scaffold that were varied in the maturation library described in Examples 4 and 5 were biased towards certain amino acid residues, according to a strategy based on the Z variant sequences of the 37 top performing variants in the EC50 analysis (Table 6). A DNA linker was generated using split-pool synthesis and ordered from DNA 2.0. It contained the following 147 bp, encoding partially randomized helix 1 and 2 of the amino acid sequence: 5'-AA ATA AAT CTC GAG GTA GAT GCC/GCA AAA TAC GCC AAA GAA/GAG NNN NNN NNN GCG NNN NNN GAG ATC/ATT NNN NNN TTA/CTG CCT/CCC AAC TTA/CTC ACC NNN NNN CAA/CAG NNN NNN GCC TTC ATC NNN AAA TTA NNN GAT GAC CCA AGC CAG AGC TCA TTA TTT A-3' (SEQ ID NO:1249, randomized codons are denoted NNN) flanked by restriction sites XhoI and SacI. The theoretical distributions of amino acid residues in the new library, including six variable amino acid positions (11, 14, 18, 25, 28 and 32) and seven constant amino acid positions (9, 10, 13, 17, 24, 27 and 35) in the Z molecule scaffold are given in Table 7. The resulting theoretical library size is $3.9 \times 10^6$ variants.

Library Construction:

The library was constructed essentially as described in Example 4 with the following exception: the cells were cultivated overnight in 0.5 l of TSB-YE medium, supplemented with 2% glucose, 10 μg/ml tetracycline and 100 μg/ml ampicillin.

Preparation of Phage Stock:

Phage stock containing the phagemid library was prepared in shake flasks. Cells from a glycerol stock containing the phagemid library were inoculated in 0.5 l of TSB-YE medium, supplemented with 2% glucose, 10 μg/ml tetracycline and 100 μg/ml ampicillin. The cultivations were grown at 37° C. until $OD_{600}$ reached 0.6 and then approximately 83 ml of the cultivation was infected using a 5× molar excess of M13K07 helper phage and incubated for 40 min at 37° C. The cells in the cultivation were pelleted by centrifugation, dissolved in TSB-YE medium, supplemented with 100 μg/ml ampicillin, 25 μg/ml kanamycin and 0.1 mM IPTG and grown at 30° C. for 18 h. After cultivation, the cells were pelleted by centrifugation at 4,000 g and the phage particles remaining in the medium were thereafter precipitated twice in PEG/NaCl, filtered and dissolved in PBS and glycerol as described in Example 1. Phage stocks were stored at −80° C. until use in selection.

TABLE 7

| Library design, second maturation | | | |
|---|---|---|---|
| Amino acid position in the Z variant molecule | Randomization (amino acid abbreviations) | No of amino acids | Proportion |
| 9 | A | 1 | 1/1 |
| 10 | D | 1 | 1/1 |
| 11 | A, D, E, F, G, H, I, K, L, M, N, Q, R, S, T V, W | 17 | 1/17 |
| 13 | A | 1 | 1/1 |
| 14 | A, F, I, L, M, V, Y | 7 | 1/7 |
| 17 | A | 1 | 1/1 |
| 18 | A, D, E, F, G, H, I, K, L, M, N, Q, R, S, V, W, Y | 17 | 1/17 |
| 24 | W | 1 | 1/1 |
| 25 | A, D (50%), E, F, I, L, M, V, W, Y | 10 | 1/18, 1/2 (D) |
| 27 | W | 1 | 1/1 |
| 28 | A, D, E, F, G, H, I, L, M, Q, W, Y | 12 | 1/12 |

TABLE 7-continued

| Library design, second maturation | | | |
|---|---|---|---|
| Amino acid position in the Z variant molecule | Randomization (amino acid abbreviations) | No of amino acids | Proportion |
| 32 | A, D, E, F, G, H, K, L, M, N, Q, R, S, T, W, Y | 16 | 1/16 |
| 35 | R | 1 | 1/1 |

Results

Library Construction:

The new library was designed based on a set of IL-17A binding Z variants with verified binding properties (Example 5). The theoretical size of the designed library was $3.9 \times 10^6$ Z variants. The actual size of the library, determined by titration after transformation to E. coli. ER2738 cells, was $1.4 \times 10^9$ transformants.

The library quality was tested by sequencing of 96 transformants and by comparing their actual sequences with the theoretical design. The contents of the actual library compared to the designed library were shown to be satisfactory. A maturated library of potential binders to IL-17A was thus successfully constructed.

Example 7

Selection, Screening and Characterization of Z Variants from the Second Maturated Library Materials and Methods Phage Display Selection of IL-17A Binding Z Variants:

The target protein hIL-17A was biotinylated as described in Example 1. Phage display selections, using the second maturated library of Z variant molecules constructed as described in Example 6, were performed against hIL-17A essentially as described in Example 5 with the following exceptions. Exception 1: selections were performed in solution or at solid phase in RT. Exception 2: the time for selection was 60 min, 10 min or 1 min in cycle 1 and 30 min, 4 min or 10 sec in cycles 2, 3 and 4. Selection in solution was followed by catching of target-phage complexes on SA beads as described in Example 1. Exception 3: during selection on solid phase, the target was caught on SA beads prior to selection.

An overview of the selection strategy, summarizing the differences between selection in solution and selection on solid phase, as well as the increased stringency in subsequent cycles obtained by using a lowered target concentration and an increased number of washes, is shown in Table 8.

Tracks 1-6 in cycle 1 were divided in the second to fourth cycles, resulting in total of seven tracks (1-1 to 6-1) in cycle 2, eight tracks (1-1-1 to 6-1-1) in cycle 3 and 16 tracks (1-1-1-1 to 6-1-1-1) in cycle 4. Washes were performed using PBST 0.1% during 1 min. However, one of the washes lasted for 15 min in tracks 2-1-1, 3-1-1 and 5-1-1 in cycle 3.

After the last wash in cycle 4, the target-phage complexes on SA beads from five of the tracks (1-1-1-1, 1-2-1-2, 3-1-1-1, 4-1-1-1 and 5-1-1-2) were divided in two equal parts. Bound phage particles from the first part were immediately eluted, while the second part was subjected to a wash during approximately 65 h before the elution of phage particles. The bound phage were eluted using glycine-HCl, pH 2.2, as described in Example 1.

The amplification of phage particles between selection cycles was performed essentially as described in Example 1.

TABLE 8

Overview of the selection from the second maturated library

| Cycle | Selection track | Phage stock from library or selection track | Target conc. (pM) | Selection time (min) | Number of 1 min washes | Number of 15 min washes | Number of ~65 h washes | Selection method |
|---|---|---|---|---|---|---|---|---|
| 1 | 1 | Zlib006IL-17A.II | 12500 | 60 | 3 | — | — | solution |
| 1 | 2 | Zlib006IL-17A.II | 12500 | 60 | 3 | — | — | solution |
| 1 | 3 | Zlib006IL-17A.II | 1250 | 60 | 3 | — | — | solution |
| 1 | 4 | Zlib006IL-17A.II | 12500 | 10 | 3 | — | — | solid phase |
| 1 | 5 | Zlib006IL-17A.II | 2500 | 10 | 3 | — | — | solid phase |
| 1 | 6 | Zlib006IL-17A.II | 2500 | 1 | 3 | — | — | solid phase |
| 2 | 1-1 | 1 | 5000 | 30 | 6 | — | — | solution |
| 2 | 1-2 | 1 | 2500 | 30 | 10 | — | — | solution |
| 2 | 2-1 | 2 | 1000 | 30 | 10 | — | — | solution |
| 2 | 3-1 | 3 | 100 | 30 | 10 | — | — | solution |
| 2 | 4-1 | 4 | 5000 | 4 | 6 | — | — | solid phase |
| 2 | 5-1 | 5 | 250 | 4 | 10 | — | — | solid phase |
| 2 | 6-1 | 6 | 250 | 0.17 | 10 | — | — | solid phase |
| 3 | 1-1-1 | 1-1 | 500 | 30 | 15 | — | — | solution |
| 3 | 1-2-1 | 1-2 | 50 | 30 | 15 | — | — | solution |
| 3 | 2-1-1 | 2-1 | 25 | 30 | 14 | 1 | — | solution |
| 3 | 3-1-1 | 3-1 | 5 | 30 | 14 | 1 | — | solution |
| 3 | 4-1-1 | 4-1 | 500 | 4 | 15 | — | — | solid phase |
| 3 | 4-1-2 | 4-1 | 50 | 4 | 15 | — | — | solid phase |
| 3 | 5-1-1 | 5-1 | 25 | 4 | 14 | 1 | — | solid phase |
| 3 | 6-1-1 | 6-1 | 5 | 0.17 | 15 | — | — | solid phase |
| 4 | 1-1-1-1 | 1-1-1 | 50 | 30 | 20 | — | — | solution |
| 4 | 1-1-1-1X | 1-1-1 | 50 | 30 | 20 | — | 1 | solution |
| 4 | 1-1-1-2 | 1-1-1 | 5 | 30 | 20 | — | — | solution |
| 4 | 1-2-1-1 | 1-2-1 | 25 | 30 | 20 | — | — | solution |
| 4 | 1-2-1-2 | 1-2-1 | 5 | 30 | 20 | — | — | solution |
| 4 | 1-2-1-2X | 1-2-1 | 5 | 30 | 20 | — | 1 | solution |
| 4 | 2-1-1-1 | 2-1-1 | 0.5 | 30 | 20 | — | — | solution |
| 4 | 3-1-1-1 | 3-1-1 | 0.05 | 30 | 20 | — | — | solution |
| 4 | 3-1-1-1X | 3-1-1 | 0.05 | 30 | 20 | — | 1 | solution |
| 4 | 4-1-1-1 | 4-1-1 | 50 | 4 | 20 | — | — | solid phase |
| 4 | 4-1-1-1X | 4-1-1 | 50 | 4 | 20 | — | 1 | solid phase |
| 4 | 4-1-2-1 | 4-1-2 | 25 | 4 | 20 | — | — | solid phase |
| 4 | 5-1-1-1 | 5-1-1 | 2.5 | 4 | 20 | — | — | solid phase |
| 4 | 5-1-1-2 | 5-1-1 | 0.5 | 4 | 20 | — | — | solid phase |
| 4 | 5-1-1-2X | 5-1-1 | 0.5 | 4 | 20 | — | 1 | solid phase |
| 4 | 6-1-1-1 | 6-1-1 | 0.5 | 0.17 | 20 | — | — | solid phase |

Sequencing of Potential Binders:

Individual clones from the different selection tracks were picked for sequencing. Amplification and sequence analysis of gene fragments were performed essentially as described in Example 1.

ELISA Screening of Z Variants:

Single colonies containing Z variants (expressed as Z variant ABD fusion proteins as described in Example 1) were randomly picked from the selected clones of the IL-17A second maturated library and grown in cultivations as described in Example 1. Preparation of the periplasmic supernatants and ELISA screenings were performed essentially as described in Example 1 with the following two exceptions. Exception 1: biotinylated hIL-17A was used at a concentration of 0.2 or 0.33 nM. Exception 2: the periplasmic fraction of Z variant Z10241 (SEQ ID NO:11), identified in selections from the first maturated library, was used as a positive control and the blank control was created by exchanging the periplasmic step with addition of PBST 0.05%.

EC50 Analysis of Z Variants:

A selection of IL-17A binding Z variants was subjected to an analysis of the response against a dilution series of b-hIL-17A using ELISA as described in Example 5. Biotinylated protein was added at a concentration of 10 nM and diluted stepwise 1:2 eight times followed by one 1:5 dilution down to 8 µM. As a background control, the Z variants were also assayed with no target protein added. A periplasm sample containing the previously maturated Z variant Z10241 (SEQ ID NO:11) was included as positive control. Data were analyzed using GraphPad Prism 5 and non-linear regression and EC50 values were calculated.

Results

Phage Display Selection of IL-17A Binding Z Variants from a Second Maturated Library:

Selection was performed in a total of 16 parallel tracks containing four cycles each. The selection tracks differed in target concentration, selection time, wash conditions and if the selection was performed in solution or on solid phase.

Sequencing:

Randomly picked clones were sequenced. Each individual Z variant was given an identification number, Z#####, as described in Example 1. In total, 759 new unique Z variant molecules were identified.

For the 704 best performing variants in the ELISA screen below, the amino acid sequences of the 58 amino acid residues long Z variants are listed in FIG. 1 and in the sequence listing as SEQ ID NO:5-10, SEQ ID NO:17-27, SEQ ID NO:32-35, SEQ ID NO:64-66 and SEQ ID NO:520-1199. The deduced IL-17A binding motifs extend from residue 8 to residue 36 in each sequence. The amino acid sequences of the 49 amino acid residues long polypeptides predicted to constitute the complete three-helix bundle within each of these Z variants extend from residue 7 to residue 55.

ELISA Screening of Z Variants:

Clones obtained after four selection cycles were produced in 96-well plates and screened for hIL-17A binding activity using ELISA. All randomly picked clones were analyzed. 704 of the 759 unique Z variants were found to give a response of 2× the blank controls or higher (0.22-2.2 AU) against hIL-17A at a concentration of 0.2 or 0.33 nM. Positive signals were collected for clones originating from all selection tracks. The average response of the blank controls was 0.11 AU, based on a representative set of plates.

EC50 Analysis of Z Variants:

A subset of IL-17A binding Z variants was selected based on the result in the ELISA experiment described above (Z variants with absorbances over the response of the positive control Z10241, SEQ ID NO:11) and subjected to a target titration in ELISA format as described in Example 5. Obtained values were analyzed and their respective EC50 values were calculated (Table 9).

TABLE 9

Calculated EC50 values from ELISA titration analysis

| Z variant | SEQ ID NO | EC50 (M) |
|---|---|---|
| Z12059 | 17 | $5.3 \times 10^{-10}$ |
| Z12060 | 5 | $5.1 \times 10^{-10}$ |
| Z12073 | 18 | $4.3 \times 10^{-10}$ |
| Z12078 | 8 | $5.2 \times 10^{-10}$ |
| Z12081 | 6 | $5.6 \times 10^{-10}$ |
| Z12115 | 20 | $4.2 \times 10^{-10}$ |
| Z12163 | 9 | $5.0 \times 10^{-10}$ |
| Z12180 | 21 | $3.7 \times 10^{-10}$ |
| Z12211 | 22 | $4.6 \times 10^{-10}$ |
| Z12212 | 64 | $7.8 \times 10^{-10}$ |
| Z12256 | 23 | $4.7 \times 10^{-10}$ |
| Z12264 | 10 | $3.9 \times 10^{-10}$ |

TABLE 9-continued

Calculated EC50 values from ELISA titration analysis

| Z variant | SEQ ID NO | EC50 (M) |
|---|---|---|
| Z12275 | 24 | $4.2 \times 10^{-10}$ |
| Z12285 | 65 | $9.1 \times 10^{-10}$ |
| Z12439 | 66 | $6.1 \times 10^{-10}$ |

Example 8

In Vitro Characterization of a Subset of Maturated IL-17A Binding Z Variants

Materials and Methods

Subcloning and production of Z variants with an N-terminal $His_6$-tag were performed as described in Example 2. One additional variant, $His_6$-Z15167 (SEQ ID NO:4), was created by site directed mutagenesis of $His_6$-Z10532 (SEQ ID NO:1) resulting in substitution of D in position 25 with A. Production of $His_6$-Z15167 was performed as described above for other Z variants.

Circular Dichroism (CD) Spectroscopy Analysis:

Purified $His_6$-tagged Z variants were diluted to 0.5 mg/ml in PBS. For each diluted Z variant, a CD spectrum at 250-195 nm was obtained at 20° C. In addition, a variable temperature measurement (VTM) was performed to determine the melting temperature (Tm). In the VTM, the absorbance was measured at 221 nm while the temperature was raised from 20 to 90° C., with a temperature slope of 5° C./min. A new CD spectrum was obtained at 20° C. after the heating procedure in order to study the refolding ability of the Z variants. The CD measurements were performed on a Jasco J-810 spectropolarimeter (Jasco Scandinavia AB) using a cell with an optical path length of 1 mm.

IL-17 Binding ELISA Screening:

96-well half area plates (Costar, 3690) were coated overnight at 4° C. with hIL-17A at 1 µg/ml in PBS in a volume of 50 µl/well. On the day of analysis, the plate was rinsed twice in tap water and then blocked with PBS+2% BSA (Sigma) for 2 h. Z10241 (SEQ ID NO:11) was used as a standard and was titrated in a 3-fold dilution series (300-0.005 ng/ml) and the other Z variants were added in four different dilutions to the coated ELISA plate (50 µl/well) and incubated for 1.5 h at RT. The plate was washed 4 times in an automated ELISA washer and 2 µg/ml (50 µl/well) of a goat anti-Z antibody was added. After 1 h of incubation, the plate was washed and 50 µl of anti-goat IgG-HRP (DAKO) diluted 5000 times was added per well. The plate was developed after another 1 h incubation, washed with 50 µl TMB (Thermo Fisher, 34021) per well and the reaction was stopped with 50 µl 2 M $H_2SO_4$. The plates were read in a multi label reader (Victor$^3$, Perkin Elmer).

Biacore Kinetic Analysis:

Kinetic constants ($k_{on}$ and $k_{off}$) and affinities ($K_D$) for human IL-17A were determined for 27 $His_6$-tagged Z variants. The hIL-17A was immobilized in the flow cell on the carboxylated dextran layer of a CM5 chip surface (GE Healthcare, cat. no. BR100012). The immobilization was performed using amine coupling chemistry according to the manufacturer's protocol and using HBS-EP (0.01 M HEPES pH 7.4, 0.15 M NaCl, 3 mM EDTA, 0.005% v/v surfactant P20, GE Healthcare, cat. no. BR100188) as running buffer. One flow cell surface on the chip was activated and deactivated for use as blank during analyte injections. In the kinetic experiment, HBS-EP was used as running buffer and the flow rate was 50 µl/min. The analytes, i.e. the Z variants, were each diluted in HBS-EP buffer to final concentrations of 100 nM, 20 nM and 4 nM and injected for 4 min, followed by dissociation in running buffer for 8 min. After 8 min dissociation, the surfaces were regenerated with two injections of 10 mM HCl. Kinetic constants were calculated from the sensorgrams using the Langmuir 1:1 model of BiaEvaluation software 4.1 (GE Healthcare).

Biacore Binding Specificity Analysis:

The interactions of three His$_6$-tagged IL-17A binding Z variants (Z10508 (SEQ ID NO:2), Z10532 (SEQ ID NO:1) and Z15167 (SEQ ID NO:4)) with hIL-17A (SEQ ID NO:1226), hIL-17F (SEQ ID NO:1228, R&D Systems, cat. no. 1335-IL/CF) and the human IL-17A/F heterodimer (R&D Systems, cat. no. 5194-IL-025/CF) were analyzed in a Biacore 2000 instrument. The three different IL-17 variants were immobilized in the flow cells on the carboxylated dextran layer of a CM5 chip surface. The immobilization was performed using amine coupling chemistry according to the manufacturer's protocol and using HBS-EP as running buffer. One flow cell surface on the chip was activated and deactivated for use as blank during analyte injections. In the binding experiment, HBS-EP was used as running buffer and the flow rate was 50 µl/min. The analytes, i.e. the Z variants, were each diluted in HBS-EP running buffer to final concentrations of 4, 20, 100 and 500 nM and injected for 4 min. After 15 min of dissociation, the surfaces were regenerated with four injections of 10 mM HCl. The results were analyzed using the BiaEvaluation software.

Blocking of IL-17A Induced IL-6 Production in the NHDF Assay:

The NHDF assay and quantification by the IL-6 specific ELISA was performed essentially as described in Example 3. In brief, on the day before the experiment, 5000 cells were seeded per well into a half area 96-well culture plates in 100 µl. On the day of the experiment, dilutions of 36 IL-17A specific Z variants were prepared in a separate 96-well plate. The Z variants were titrated in three-fold steps from 4690 nM to 0.08 nM in medium containing 0.9 nM hIL-17A. A standard curve of hIL-17A (6.2-0.0001 nM) was prepared, as well as controls containing medium with 0.9 nM hIL-17A or medium alone.

Results

Cd Analysis:

The CD spectra determined for the IL-17A binding Z variants with a His$_6$ tag showed that each had a α-helical structure at 20° C. The results of the variable temperature measurements, wherein melting temperatures (Tm) were determined, are shown in Table 10. Reversible folding was seen for all the IL-17A binding Z variants when overlaying spectra measured before and after heating to 90° C.

Analysis of IL-17A Binding Capacity by ELISA:

Purified His$_6$-tagged Z variant molecules from the first and second maturation round were screened for their capacity to bind IL-17A in an ELISA assay. The results are shown in FIG. 3 as percent binding capacity compared to the variant Z10241.

Biacore Kinetic Analysis:

The interactions of 28 His$_6$-tagged IL-17A-binding Z variants with hIL-17A were analyzed in a Biacore instrument by injecting various concentrations of the Z variants over a surface containing immobilized IL-17A. A summary of the kinetic parameters (K$_D$, k$_a$ (k$_{on}$) and k$_d$ (k$_{off}$)) for binding of the Z variants to hIL-17A using a 1:1 interaction model is given in Table 11.

TABLE 10

Melting temperatures (Tm)

| Analyte | SEQ ID NO of Z variant | Tm (° C.) |
|---|---|---|
| His6-Z10241 | 11 | 48 |
| His6-Z10433 | 28 | 56 |
| His6-Z10462 | 12 | 51 |
| His6-Z10508 | 2 | 54 |
| His6-Z10532 | 1 | 57 |
| His6-Z10534 | 13 | 41 |
| His6-Z10566 | 14 | 51 |
| His6-Z10675 | 15 | 52 |
| His6-Z10681 | 29 | 52 |
| His6-Z10718 | 16 | 48 |
| His6-Z10722 | 30 | 51 |
| His6-Z10859 | 31 | 52 |
| His6-Z10863 | 3 | 51 |
| His6-Z12059 | 17 | 50 |
| His6-Z12060 | 5 | 52 |
| His6-Z12073 | 18 | 49 |
| His6-Z12077 | 19 | 52 |
| His6-Z12078 | 8 | 51 |
| His6-Z12081 | 6 | 50 |
| His6-Z12115 | 20 | 51 |
| His6-Z12163 | 9 | 54 |
| His6-Z12180 | 21 | 51 |
| His6-Z12192 | 32 | 45 |
| His6-Z12211 | 22 | 49 |
| His6-Z12256 | 23 | 47 |
| His6-Z12264 | 10 | 54 |
| His6-Z12275 | 24 | 46 |
| His6-Z12283 | 25 | 45 |
| His6-Z12289 | 33 | 51 |
| His6-Z12344 | 26 | 49 |
| His6-Z12481 | 27 | 49 |
| His6-Z12498 | 34 | 48 |
| His6-Z12522 | 35 | 51 |
| His6-Z12634 | 7 | 50 |
| Z10241-His6 | 11 | 47 |
| His6-Z15167 | 4 | 57 |
| Z10199 | 1217 | 56 |

Figure 4A:
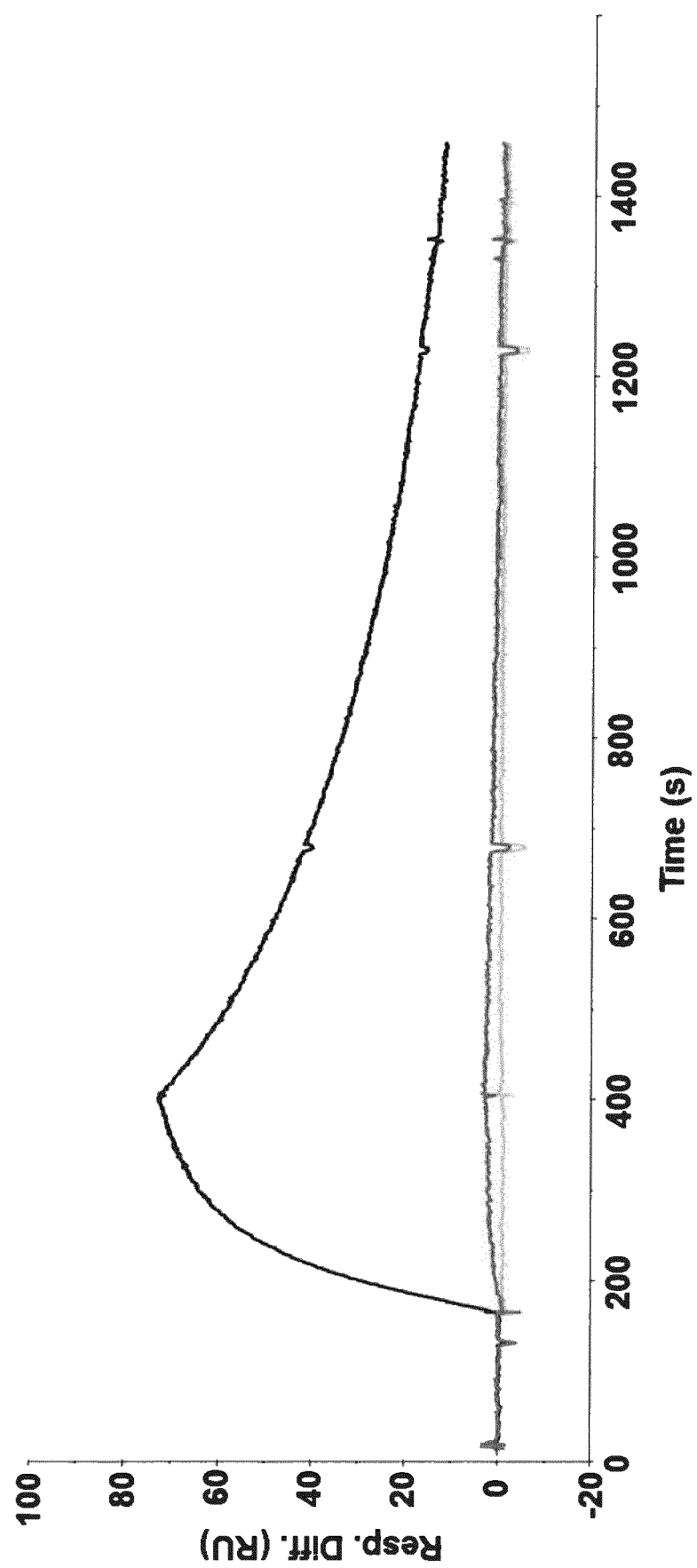
FIG. 4 shows the result of binding specificity analysis performed in a Biacore instrument as described in Example 8. Sensorgrams were obtained by injection of 20 nM of the $His_6$-tagged Z variants Z10508 (SEQ ID NO:2) (A), Z10532 (SEQ ID NO:1) (B) and Z15167 (SEQ ID NO:4) (C) over human IL-17A (black), human IL-17A/F (dark grey) and human IL-17F (light grey), respectively, immobilized on the surface of a CM5 chip.
Figure 4B:
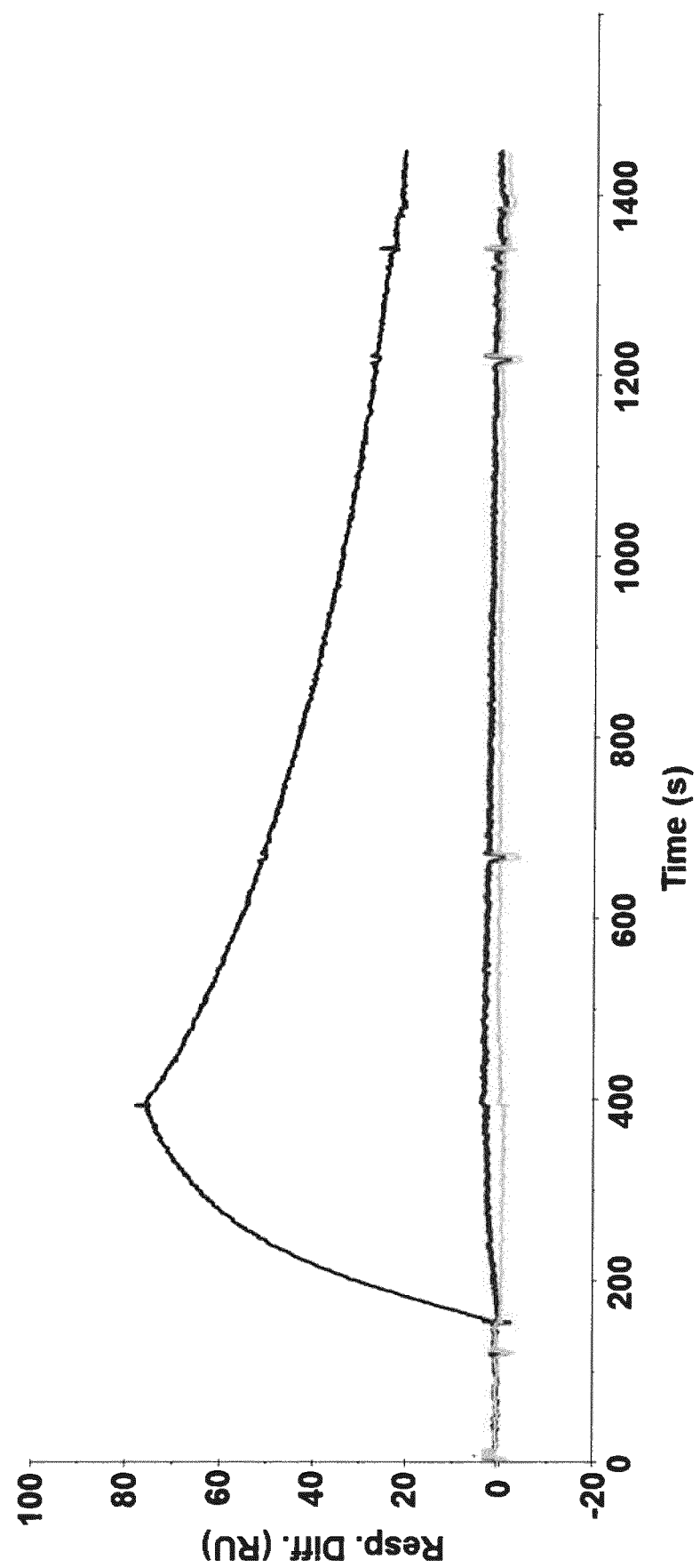
Figure 4C:
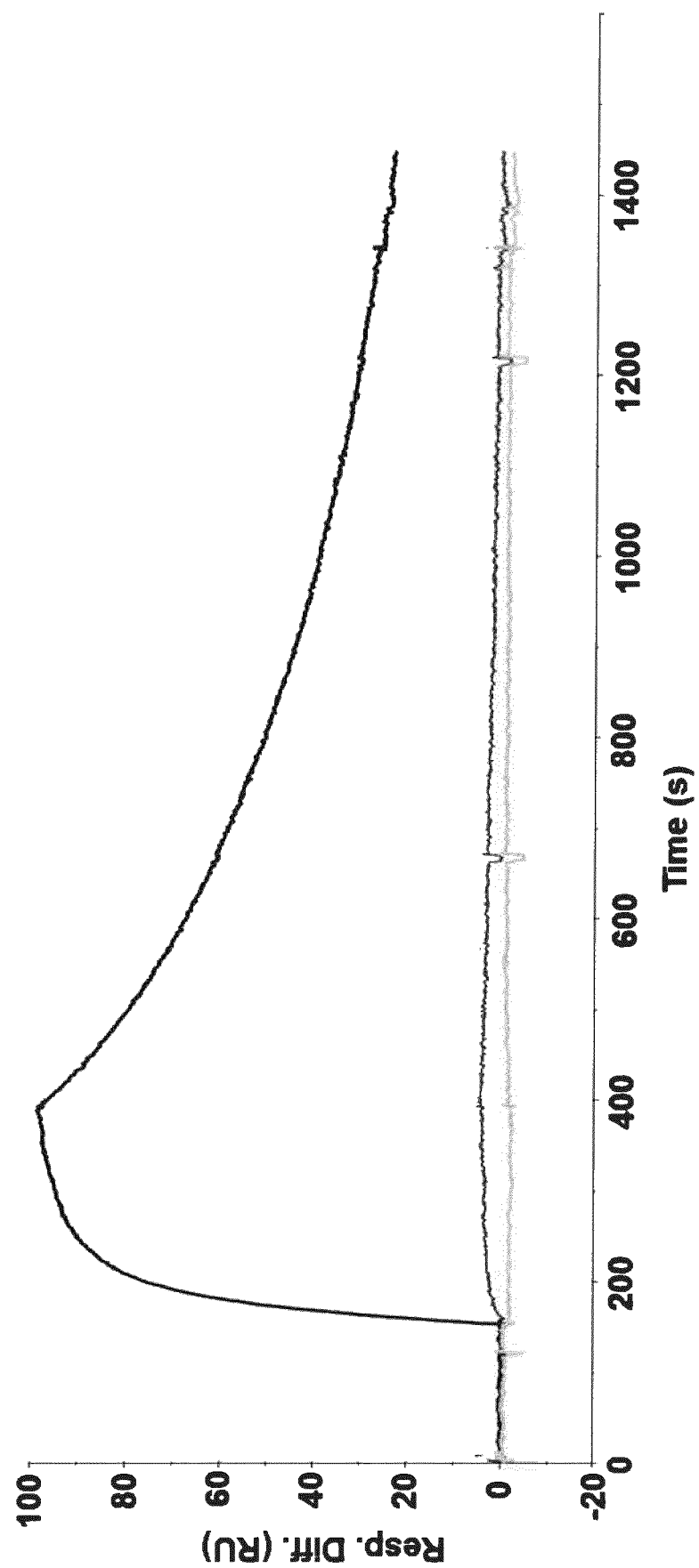

Biacore Binding Specificity Analysis:

The binding of three His$_6$-tagged IL-17A binding Z variants (Z10508, Z10532 and Z15167) to hIL-17A, hIL-17F and hIL-17A/F were tested in a Biacore instrument by injecting the Z variants over surfaces containing the IL-17 variants. The ligand immobilization levels on the surfaces were 657 RU, 977 RU and 770 RU of IL-17A, IL-17F and IL-17A/F, respectively. All tested Z variants showed binding to human IL-17A and weaker binding to IL-17A/F, whereas no binding to IL-17F could be detected. The resulting curves, from which responses from a blank surface were subtracted, are displayed in FIG. 4. Z15167 showed the fastest association curve to human IL-17A.

Figure 5:
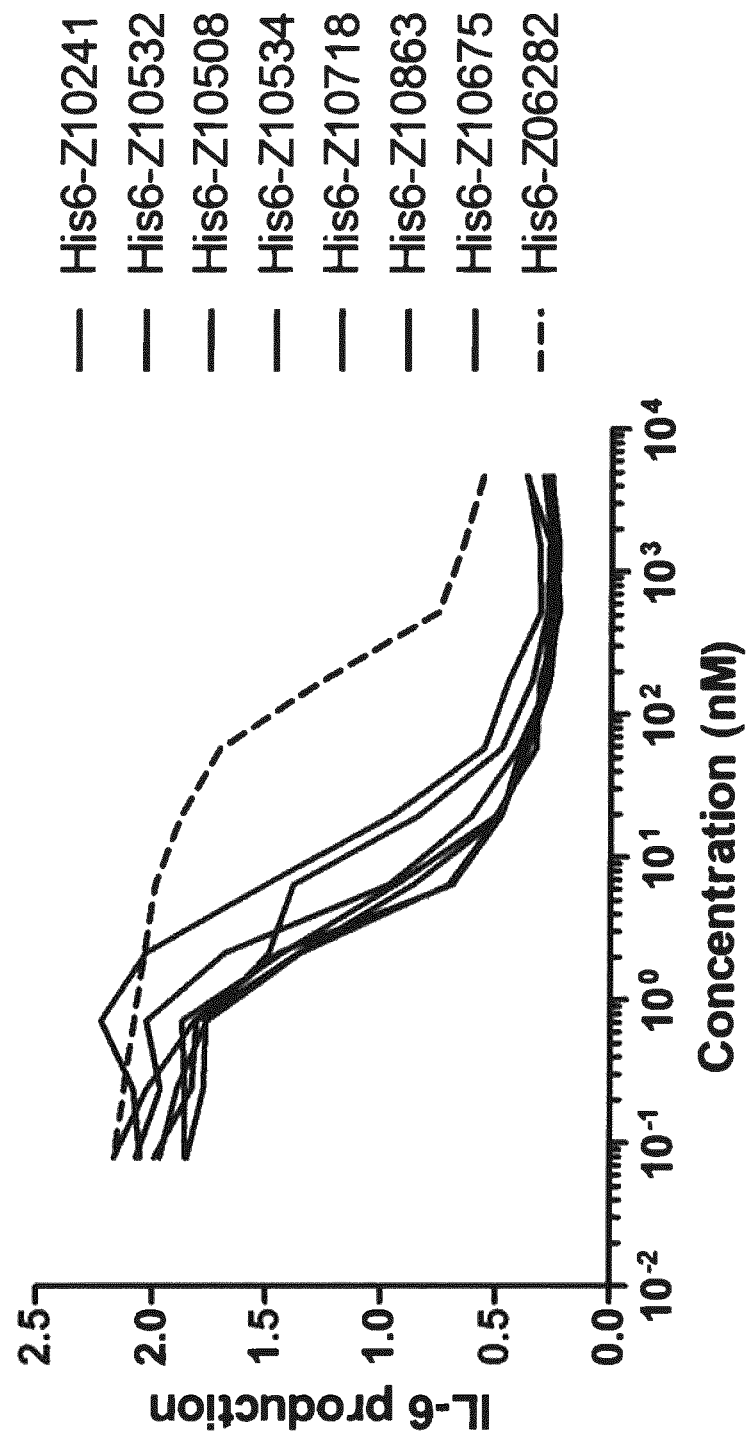
FIG. 5 shows inhibition of IL-17A induced IL-6 production for a selection of Z variants originating from the first maturation selection (solid curves) compared to one binder from the primary selection (broken curve) assayed as described in Example 8. All binders inhibited IL-17A in a dose dependent manner and the maturated binders had an increased blocking capacity compared to the primary binder.

Blocking of IL-17A Induced IL-6 Production in the NHDF Assay:

Purified His$_6$-tagged Z variants from the first and second maturation rounds were screened for their capacity to block IL-17A induced IL-6 production in the NHDF assay. Results from the NHDF assay showed that all tested maturated binders had an increased IL-17A specific blocking capacity compared to the primary binder His$_6$-Z06282. A graph displaying typical inhibition profiles of a selection of binders from the first maturation library are shown in FIG. 5, and the calculated IC50 values for all analysed binders are shown in Table 12.

TABLE 11

Kinetic parameters for binding of Z variants to hIL-17A

| Analyte | SEQ ID NO of Z variant | $k_a$ (1/Ms) | $k_d$ (1/s) | $K_D$ (M) |
|---|---|---|---|---|
| His6-Z10241 | 11 | $5.2 \times 10^5$ | $1.2 \times 10^{-3}$ | $2.2 \times 10^{-9}$ |
| His6-Z10433 | 28 | $4.7 \times 10^5$ | $3.1 \times 10^{-3}$ | $6.4 \times 10^{-9}$ |
| His6-Z10508 | 2 | $5.1 \times 10^5$ | $2.0 \times 10^{-3}$ | $4.0 \times 10^{-9}$ |
| His6-Z10532 | 1 | $6.2 \times 10^5$ | $1.5 \times 10^{-3}$ | $2.4 \times 10^{-9}$ |
| His6-Z10566 | 14 | $6.1 \times 10^5$ | $5.7 \times 10^{-3}$ | $9.3 \times 10^{-9}$ |
| His6-Z10675 | 15 | $5.7 \times 10^5$ | $1.1 \times 10^{-3}$ | $1.9 \times 10^{-9}$ |
| His6-Z10681 | 29 | $6.7 \times 10^5$ | $3.5 \times 10^{-3}$ | $5.2 \times 10^{-9}$ |
| His6-Z10859 | 31 | $5.6 \times 10^5$ | $6.8 \times 10^{-3}$ | $1.2 \times 10^{-8}$ |
| His6-Z10863 | 3 | $8.3 \times 10^5$ | $2.5 \times 10^{-3}$ | $3.0 \times 10^{-9}$ |
| His6-Z12060 | 5 | $7.5 \times 10^5$ | $3.3 \times 10^{-3}$ | $4.3 \times 10^{-9}$ |
| His6-Z12073 | 18 | $4.9 \times 10^5$ | $1.2 \times 10^{-3}$ | $2.3 \times 10^{-9}$ |
| His6-Z12077 | 19 | $6.5 \times 10^5$ | $2.0 \times 10^{-3}$ | $3.1 \times 10^{-9}$ |
| His6-Z12078 | 8 | $4.5 \times 10^5$ | $8.1 \times 10^{-4}$ | $1.8 \times 10^{-9}$ |
| His6-Z12081 | 6 | $6.2 \times 10^5$ | $3.8 \times 10^{-3}$ | $6.2 \times 10^{-9}$ |
| His6-Z12163 | 9 | $7.3 \times 10^5$ | $1.6 \times 10^{-3}$ | $2.2 \times 10^{-9}$ |
| His6-Z12192 | 32 | $4.6 \times 10^5$ | $5.6 \times 10^{-3}$ | $1.2 \times 10^{-8}$ |
| His6-Z12211 | 22 | $5.8 \times 10^5$ | $1.4 \times 10^{-3}$ | $2.4 \times 10^{-9}$ |
| His6-Z12256 | 23 | $3.5 \times 10^5$ | $1.2 \times 10^{-3}$ | $3.4 \times 10^{-9}$ |
| His6-Z12264 | 10 | $6.0 \times 10^5$ | $5.5 \times 10^{-4}$ | $9.3 \times 10^{-10}$ |
| His6-Z12275 | 24 | $5.2 \times 10^5$ | $1.1 \times 10^{-3}$ | $2.0 \times 10^{-9}$ |
| His6-Z12283 | 25 | $5.5 \times 10^5$ | $1.8 \times 10^{-3}$ | $3.3 \times 10^{-9}$ |
| His6-Z12289 | 33 | $6.2 \times 10^5$ | $3.3 \times 10^{-3}$ | $5.3 \times 10^{-9}$ |
| His6-Z12344 | 26 | $7.1 \times 10^5$ | $6.6 \times 10^{-4}$ | $9.2 \times 10^{-10}$ |
| His6-Z12481 | 27 | $5.2 \times 10^5$ | $8.9 \times 10^{-4}$ | $1.7 \times 10^{-9}$ |
| His6-Z12498 | 34 | $6.0 \times 10^5$ | $2.3 \times 10^{-3}$ | $3.8 \times 10^{-9}$ |
| His6-Z12522 | 35 | $7.1 \times 10^5$ | $4.4 \times 10^{-3}$ | $6.2 \times 10^{-9}$ |
| His6-Z12634 | 7 | $6.9 \times 10^5$ | $4.3 \times 10^{-3}$ | $6.3 \times 10^{-9}$ |
| His6-Z15167 | 4 | $1.3 \times 10^6$ | $1.4 \times 10^{-3}$ | $1.1 \times 10^{-9}$ |

TABLE 12

IC50 values for maturated Z-variants

| Analyte | SEQ ID NO of Z variant: | IC50 (nM) |
|---|---|---|
| His6-Z10241 | 11 | 5.3 |
| His6-Z10433 | 28 | 14 |
| His6-Z10462 | 12 | 6.6 |
| His6-Z10508 | 2 | 5.7 |
| His6-Z10532 | 1 | 6.4 |
| His6-Z10534 | 13 | 6.5 |
| His6-Z10566 | 14 | 9.6 |
| His6-Z10675 | 15 | 5.3 |
| His6-Z10681 | 29 | 25 |
| His6-Z10718 | 16 | 28 |
| His6-Z10722 | 30 | 35 |
| His6-Z10859 | 31 | 26 |
| His6-Z10863 | 3 | 8.5 |
| His6-Z12059 | 17 | 3.7 |
| His6-Z12060 | 5 | 7.9 |
| His6-Z12073 | 18 | 4.0 |
| His6-Z12077 | 19 | 5.5 |
| His6-Z12078 | 8 | 4.5 |
| His6-Z12081 | 6 | 8.1 |
| His6-Z12115 | 20 | 3.0 |
| His6-Z12163 | 9 | 7.0 |
| His6-Z12180 | 21 | 4.3 |
| His6-Z12192 | 32 | 28 |
| His6-Z12211 | 22 | 2.9 |
| His6-Z12256 | 23 | 4.4 |
| His6-Z12264 | 10 | 4.4 |
| His6-Z12275 | 24 | 4.8 |
| His6-Z12283 | 25 | 6.9 |
| His6-Z12289 | 33 | 18 |
| His6-Z12344 | 26 | 4.8 |
| His6-Z12481 | 27 | 3.0 |
| His6-Z12498 | 34 | 11 |
| His6-Z12522 | 35 | 10 |
| His6-Z12634 | 7 | 9.8 |
| Z10241-His6 | 11 | 3.3 |

Example 9

Production of IL-17 Binding Z-ABD-Z Polypeptides

IL-17A is a homodimeric cytokine that possesses two receptor binding sites. It was speculated that a polypeptide comprising two moieties of an IL-17A binding Z variant of the present disclosure would block IL-17A more efficiently than a polypeptide comprising one such moiety. This Example describes the general procedure for subcloning and production of polypeptides comprising two Z variants in fusion with the albumin binding domain variant PP013 (SEQ ID NO:1224) in the general format Z-[L1]-ABD-[L2]-Z where [L1] and [L2] are linkers separating the Z and ABD moieties.

Materials and Methods

Subcloning of Z-[L1]-ABD-[L2]-Z Polypeptides with Different [L1] and [L2] Linker Lengths:

The DNA of Z06282 (SEQ ID NO:1206), Z10241 (SEQ ID NO:11) and Z10532 (SEQ ID NO:1) were amplified from the library vector pAY02592 by PCR using Pfu Turbo DNA polymerase (Agilent Technologies, cat. no. 600254) together with suitable primer pairs. The Z-[L1]-ABD-[L2]-Z constructs were generated by ligation of DNA encoding each moiety into the expression vector pET26b(+) (Novagen, Madison, Wis.) in three subsequent cloning steps using T4 DNA ligase (Fermentas, cat.no. EL0011). DNA encoding the three moieties were separated by DNA encoding hybridized linkers with different number of repeats of $(GGGGS)_n$, flanked by restriction enzyme sites. The constructs encoded by the expression vectors were Z#####-[GAP-($G_4$S[SEQ ID NO:1301])$_n$-TS]P013-[GT-($G_4$S[SEQ ID NO:1301])$_n$-PR]-Z#####, where each n individually is 1-4, and as further specified in Table 13.

TABLE 13

Dimeric Z variants fused to ABD via different [L1] and [L2] lengths

| Designation | SEQ ID NO | Z-[L1]-ABD-[L2]-Z polypeptide |
|---|---|---|
| ZAZ3174 | 1233 | Z06282-[GAP-($G_4$S)$_4$-TS]-PP013-[GT-($G_4$S)$_4$-PR]-Z06282 |
| ZAZ3175 | 1234 | Z06282-[GAP-($G_4$S)$_3$-TS]-PP013-[GT-($G_4$S)$_3$-PR]-Z06282 |
| ZAZ3176 | 1235 | Z06282-[GAP-($G_4$S)$_2$-TS]-PP013-[GT-($G_4$S)$_2$-PR]-Z06282 |
| ZAZ3236 | 1240 | Z06282-[GAP-$G_4$S-TS]-PP013-[GT-$G_4$S-PR]-Z06282 |
| ZAZ3237 | 1241 | Z06282-[GAP-$G_4$S-TS]-PP013-[GT-($G_4$S)$_2$-PR]-Z06282 |
| ZAZ3220 | 1236 | Z10241-[GAP-($G_4$S)$_4$-TS]-PP013-[GT-($G_4$S)$_4$-PR]-Z10241 |
| ZAZ3221 | 1237 | Z10532-[GAP-($G_4$S)$_4$-TS]-PP013-[GT-($G_4$S)$_4$-PR]-Z10532 |

Restriction sites (I)-(IV) in DNA encoding Z#####-[(I)-($G_4$S)n-(II)]-PP013-[(III)-($G_4$S)n-(IV)]-Z##### are cleavable with restriction enzymes AscI (I), SpeI (II), KpnI (III) and SacII (IV), respectively Subcloning of Z-[L1]-ABD-[L2]-Z Polypeptides with a Minimal [L1] Linker:

DNA encoding additional dimeric Z variants comprising Z06282 (SEQ ID NO:1206) but with a minimal linker [L1] were generated using standard molecular biology techniques. The constructs encoded by the expression vectors were Z06282-VDGS(SEQ ID NO:1311)-PP013-GT-($G_4$S [SEQ ID NO:1301])$_n$-PR-Z06282 and as further specified in Table 14.

The genes encoding Z12876 (SEQ ID NO:1218), Z14253 (SEQ ID NO:1219), Z14254 (SEQ ID NO:1220) and Z14255 (SEQ ID NO:1221) (corresponding to Z10241 (SEQ ID NO:11), Z10532 (SEQ ID NO:1), Z10508 (SEQ ID NO:2) and Z10863 (SEQ ID NO:3), respectively, but starting with the amino acid residues AE instead of VD) were amplified by PCR using Pfu Turbo DNA polymerase together with suitable primer pairs. The Z-[L1]-ABD-[L2]-Z constructs were generated by ligation of each fragment into the expression vector pET26b(+) in three subsequent cloning steps using T4 DNA ligase. DNA encoding the three moieties were separated by linkers further modified by site-directed mutagenesis using standard molecular biology techniques. The constructs encoded by the expression vectors were Z####-[VDGS(SEQ ID NO:1311)]-PP013-[GT-G$_4$S-PK (SEq ID NO:1317)]-Z#### and Z#####-[ASGS (SEQ ID NO:1312)]-PP013-[GT-G$_4$S(SEQ ID NO:1306)]-Z#####, and as further specified in Table 14.

TABLE 14

Dimeric Z variants fused to ABD via a minimal [L1] linker

| Designation | SEQ ID NO | Z-[L1]-ABD-[L2]-Z polypeptide | Mutations |
|---|---|---|---|
| ZAZ3234 | 1238 | Z06282-[VDGS]-PP013-GT-G$_4$S-PR-Z06282 | |
| ZAZ3235 | 1239 | Z06282-[VDGS]-PP013-GT-(G$_4$S)$_2$-PR-Z06282 | |
| ZAZ3269 | 1242 | Z12876-[VDGS]-PP013-[GT-G$_4$S-PK]-Z12876 | R117K |
| ZAZ3270 | 1243 | Z12876-[ASGS]-PP013-[GT-G$_4$S]-Z12876 | V59A, D60S, Δ116P, Δ117R |
| ZAZ3363 | 1244 | Z14253-[ASGS]-PP013-[GT-G$_4$S]-Z14253 | V59A, D60S, Δ116P, Δ117R |
| ZAZ3364 | 1245 | Z14254-[ASGS]-PP013-[GT-G$_4$S]-Z14254 | V59A, D60S, Δ116P, Δ117R |
| ZAZ3365 | 1246 | Z14255-[ASGS]-PP013-[GT-G$_4$S]-Z14255 | V59A, D60S, Δ116P, Δ117R |
| ZAZ3422 | 1247 | Z15166-[ASGS]-PP013-[GT-G$_4$S]-Z15166 | D25A in both Z14253 moieties in ZAZ3363 |

Δdeletion of the indicated amino acid residue

Cultivation:

E. coli BL21(DE3) cells (Novagen) were transformed with plasmids containing the gene fragment of each respective Z-ABD-Z polypeptide and cultivated at 37° C. in 800 or 1000 ml of TSB-YE medium supplemented with 50 μg/ml kanamycin. In order to induce protein expression, IPTG was added to a final concentration of 0.2 mM at OD$_{600}$=2 and the cultivation was incubated at 37° C. for another 5 h. The cells were harvested by centrifugation.

Purification of IL-17A Binding Z-ABD-Z Polypeptides:

Cell pellets were re-suspended in TST buffer (25 mM Tris-HCl, 1 mM EDTA, 200 mM NaCl, 0.05% Tween 20, pH 8.0) supplemented with Benzonase® (Merck). After cell disruption by sonication and clarification by centrifugation, each supernatant was applied onto a column packed with agarose and immobilized with an anti-ABD ligand (produced in-house). After washing with TST buffer and 5 mM NH$_4$Ac pH 5.5 buffer, the Z-ABD-Z polypeptides were eluted with 0.1 M HAc. Acetonitrile (ACN) was added to eluted fractions to a final concentration of 10% and the samples were loaded on SOURCE 15RPC columns (GE Healthcare), previously equilibrated with RPC solvent A (0.1% TFA, 10% ACN, 90% water). After column wash with RPC solvent A, bound proteins were eluted with a linear gradient from RPC solvent A to RPC solvent B (0.1% TFA, 80% ACN, 20% water). Fractions containing pure Z-ABD-Z polypeptides were identified by SDS-PAGE analysis and pooled. After the RPC purification, the buffer of the pool was exchanged to PBS (2.68 mM KCl, 137 mM NaCl, 1.47 mM KH$_2$PO$_4$, 8.1 mM Na$_2$HPO$_4$, pH 7.4) using Sephadex G-25 columns (GE Healthcare). Finally, the Z-ABD-Z variants were purified on EndoTrap® red columns (Hyglos) to ensure low endotoxin content.

Protein concentrations were determined by measuring the absorbance at 280 nm, using a NanoDrop® ND-1000 spectrophotometer and the extinction coefficient of the respective protein. Purity was analyzed by SDS-PAGE stained with Coomassie Blue, and the identity of each purified Z-ABD-Z variant was confirmed by HPLC-MS analysis.

Results

Cultivation and Purification:

The IL-17A binding Z variants in fusion with ABD were expressed as soluble gene products in E. coli. SDS-PAGE analysis of each final protein preparation showed that these predominantly contained the desired IL-17A binding Z-ABD-Z polypeptide. The correct identity and molecular weight of each Z-ABD-Z polypeptide were confirmed by HPLC-MS analysis.

Example 10

Solubility of Z-ABD-Z Polypeptides

The solubility of three Z-ABD-Z polypeptides in physiological buffer was investigated by consecutive concentrations of the samples using ultrafiltration, followed by concentration measurements by absorbance readings at 280 nm and visual inspection of the samples.

Materials and Methods

The Z-ABD-Z polypeptides ZAZ3363 (SEQ ID NO:1244), ZAZ3364 (SEQ ID NO:1245) and ZAZ3422 (SEQ ID NO:1247) were diluted in PBS, pH 7.4, to 2.5 mg/ml. 12 Amicon Ultra centrifugal filter units with a cut-off of 3 kDa (Millipore, cat. no. UFC800324) were prerinsed with PBS by centrifugation at 4000 g for 10 min in a swinging bucket rotor centrifuge. The concentrators were emptied, and 4 ml of each Z-ABD-Z polypeptide were added to a first set of three different centrifugal filter units. Centrifugation was performed at 4000 g, 20° C., for 13-16 min, resulting in approximately 1 ml concentrate. A 20 μl sample was removed from each concentrate (UF sample 1) for further analysis and the rest of the sample volumes were transferred to a second set of three centrifugal filter units. The centrifugation and sample removal were repeated three times with spinning times of 8-10 min, 7 min and 13 min, respectively, (UF samples 2, 3 and 4, respectively). Absorbance readings were performed using a NanoDrop® ND-1000 Spectrophotometer and by diluting UF samples 1-4 in PBS 3, 6, 12 and 24 times, respectively. The concentrations were calculated using the theoretical extinction coefficient 1 Abs280=0.612 mg/ml (the same for all three Z-ABD-Z polypeptides). Absorbance readings of the undiluted filtrates were also performed.

Results

Concentrations determined by absorbance readings at 280 nm after each centrifugal step are shown in Table 15. No aggregates were detected by visual inspection of the concentrates. Thus, the solubility of ZAZ3363, ZAZ3364 and ZAZ3422 were determined to be at least 60 mg/ml in PBS, pH 7.4. Absorbance readings of the undiluted filtrates showed concentrations very close to 0 mg/ml.

TABLE 15

Concentration after consecutive concentration of Z-ABD-Z samples

| Z-ABD-Z polypeptide | SEQ ID NO | Concentration (mg/ml) | | | | Total time of centrifugation (min) |
|---|---|---|---|---|---|---|
| | | UF1 | UF2 | UF3 | UF4 | |
| ZAZ3363 | 1244 | 9.6 | 21 | 36 | 64 | 44 |
| ZAZ3364 | 1245 | 8.2 | 21 | 38 | 60 | 43 |
| ZAZ3322 | 1247 | 9.3 | 20 | 35 | 64 | 44 |

Example 11

Biacore Binding Cross-Species Analysis

Materials and Methods

The interaction of the Z-ABD-Z polypeptides ZAZ3363 (SEQ ID NO:1244), ZAZ3364 (SEQ ID NO:1245) and ZAZ3365 (SEQ ID NO:1246) with hIL-17A and cynomolgus monkey IL-17A (cIL-17A, SEQ ID NO:1229, Evitria, custom order) as well as the interaction of ZAZ3220 (SEQ ID NO:1236) with hIL-17A and rhesus monkey IL-17A (rmIL-17-A, SEQ ID NO:1230, Cusabio, cat. no. CSB-EP011597MOV) were analyzed in a Biacore 2000. HSA was immobilized in the flow cell on the carboxylated dextran layer of a CM5 chip surface. The immobilization was performed using amine coupling chemistry according to the manufacturer's protocol and using HBS-EP as running buffer. The HSA immobilization levels on the surfaces were 953 RU (used for ZAZ3363, ZAZ3364 and ZAZ3365) and 493 RU (used for ZAZ3220), respectively. One flow cell surface on the chip was activated and deactivated for use as blank during analyte injections. In the binding experiments, HBS-EP was used as running buffer and the flow rate was 30 μl/min. ZAZ3363, ZAZ3364 and ZAZ3365 were diluted in HBS-EP running buffer to a final concentration of 200 nM and injected for 5 min, followed by injections of the IL-17A variants. ZAZ3220 was diluted in HBS-EP running buffer to a final concentration of 500 nM and injected for 4 min followed by injections of the IL-17A variants. hIL-17A and cIL-17A were each diluted in HBS-EP running buffer to final concentrations of 2.5, 10 and 40 nM and injected for 5 min over surfaces with ZAZ3363, ZAZ3364 and ZAZ3365 captured on HSA. After 10 min of dissociation, the surface was regenerated with two injections of 10 mM HCl. hIL-17A and rmIL-17A were diluted in HBS-EP running buffer to final concentrations of 0.1, 0.3, 0.9, 2.7, and 8.1 nM and 2.7, 8.1, 24.3, 72 and 216 nM, respectively, and injected for 6 min over surfaces with ZAZ3220 captured on HSA. After 5 min of dissociation, the surface was regenerated with two injections of 10 mM HCl. The results were analyzed using the BiaEvaluation software.

Results

Binding of hIL-17A and cIL-17A to ZAZ3363, ZAZ3364 and ZAZ3365, and hIL-17A and rmIL-17A to ZAZ3220 were tested in a Biacore instrument by injecting the Z-ABD-Z polypeptides over a surface containing HSA followed by injections of the IL-17A variants. All tested Z variants showed binding to the tested IL-17A variants, i.e. ZAZ3363, ZAZ3364 and ZAZ3365 showed binding to human and cynomolgus monkey IL-17A (FIG. 6) and ZAZ3220 to human and rhesus monkey IL-17A.

Example 12

Biacore Binding Specificity Analysis

In this Example, the specificities of two Z-ABD-Z polypeptides were tested by analysing their potential interaction with a set of proteins of the IL-17 family, with other interleukins and with other abundant plasma proteins. The same set of analyte proteins were also analyzed for their potential interaction with the ABD variant PEP07843.

Materials and Methods

The interaction of ZAZ3363 (SEQ ID NO:1244) or ZAZ3422 (SEQ ID NO:1247) with panels of 24 or 12 different proteins (specified in Table 16), respectively, were analyzed in a Biacore 2000 instrument. HSA and the ABD variant PEP07843 (SEQ ID NO:1225, corresponding to PP013 (SEQ ID NO:1224) with an N-terminal extension of GSS) were immobilized on a CM5 chip surface and a blank surface was prepared as described in Example 11. The ligand immobilization levels on the surfaces were 1315 RU and 99 RU of HSA and PEP07843, respectively, for the chip used in ZAZ3363 runs, and 791 RU and 100 RU of HSA and PEP07843, respectively, for the chip used in ZAZ3422 runs. In the binding experiment, HBS-EP was used as running buffer and the flow rate was 30 µl/min. ZAZ3363 and ZAZ3422 were diluted in HBS-EP or HBS-EP supplemented with 500 mM NaCl to a final concentration of 200 nM and injected for 7 min followed by injections of the analytes. The analytes, i.e. the panels of 24 or 12 different proteins, were each diluted in HBS-EP or HBS-EP supplemented with 500 mM NaCl to final concentrations of from 0.4 to 250 nM and injected for 5 min. After 7 (ZAZ3363) or 10 (ZAZ3422) min of dissociation, the surfaces were regenerated with four (ZAZ3363) or five (ZAZ3422) injections of 10 mM NaOH and two injections of 10 mM HCl. The results were analyzed using the BiaEvaluation software.

TABLE 16

| Analyte proteins tested with ZAZ3363 and ZAZ3422 | | | | | |
|---|---|---|---|---|---|
| First injection | | Second injection | | | |
| ZAZ3363 (200 nM) | ZAZ3422 (200 nM) | Analyte protein | Cat. No. | Analyte conc. (nM) | Buffer for sample dilution |
| Yes | Yes | hIL-17A[1] | 200-17 | 2, 10, 50 | HBS-EP and HBS-EP + NaCl |
| Yes | Yes | hIL-17A/F[2] | 5194-IL-025/CF | 50, 250 | HBS-EP + NaCl |
| Yes | Yes | hIL-17B[2] | 1248-IB-025/CF | 50, 250 | HBS-EP + NaCl |
| Yes | Yes | hIL-17C[2] | 1234-IL-025/CF | 50, 250 | HBS-EP |
| Yes | Yes | hIL-17D[2] | 1504-IL-025/CF | 50, 250 | HBS-EP + NaCl |
| Yes | Yes | hIL-17E[2] | 1258-IL-025/CF | 50, 250 | HBS-EP |
| Yes | Yes | hIL-17F[2] | 1335-IL/CF | 50, 250 | HBS-EP + NaCl |
| Yes | Yes | hIL-1beta[1] | 200-1B | 50, 250 | HBS-EP |

TABLE 16-continued

Analyte proteins tested with ZAZ3363 and ZAZ3422

| First injection ZAZ3363 (200 nM) | ZAZ3422 (200 nM) | Analyte protein | Cat. No. | Second injection Analyte conc. (nM) | Buffer for sample dilution |
|---|---|---|---|---|---|
| Yes | Yes | hIL-6[2] | 206IL/CF | 50, 250 | HBS-EP |
| Yes | Yes | hIL23[2] | 1290-IL | 50, 250 | HBS-EP |
| Yes | Yes | hGM-CSF[2] | 215-GM/CF | 50, 250 | HBS-EP |
| Yes | Yes | IgG (RoActemra)[3] | ATC L04AC07 | 50, 250 | HBS-EP |
| Yes | No | IgA[4] | P80-102 | 50, 250 | HBS-EP |
| Yes | No | IL-17RA[2] | 177-IR | 50, 250 | HBS-EP |
| Yes | No | IL-1R1[2] | 269-1R/CF | 50, 250 | HBS-EP |
| Yes | No | Alpha-2-HS-glycoprotein (AHSG Human HEK)[5] | PRO-1644 | 50, 250 | HBS-EP |
| Yes | No | Haptoglobin Human (seems to be beta chain)[5] | PRO-567 | 50, 250 | HBS-EP |
| Yes | No | Alpha-1-antitrypsin (SERPINA1 Human)[5] | PRO-529 | 50, 250 | HBS-EP |
| Yes | No | Human a-2 macroglobulin[6] | 10952-H08B | 50, 250 | HBS-EP |
| Yes | No | Human Hemopexin/HPX Protein[6] | 10870-H08H | 50, 250 | HBS-EP |
| Yes | No | AMBP/Alpha 1 microglobulin[6] | 13141-H08H1 | 50, 250 | HBS-EP |
| Yes | No | Beta-2-microglobulin/B2M[6] | 11976-H08H | 50, 250 | HBS-EP |
| Yes | No | Transthyretin/TTR/Prealbumin/PALB Protein[6] | 12091-H08H | 50, 250 | HBS-EP |
| Yes | No | holo-Transferrin[7] | T4132 | 50, 250 | HBS-EP |
| Yes | No | IL-17RA[2] | 177-IR | 50, 250 | HBS-EP |
| Yes | No | IL-1R1[2] | 269-1R/CF | 50, 250 | HBS-EP |

Suppliers:
[1] Peprotech;
[2] R&D Systems;
[3] Roche/Apoteket AB;
[4] Bethyl;
[5] ProSpec;
[6] Sino Biological Inc;
[7] Sigma Results The specificity of ZAZ3363 and ZAZ3422 was tested in a Biacore instrument by investigating their interaction with 24 or 12 analyte proteins, respectively. The Z-ABD-Z polypeptides were injected over surfaces containing HSA followed by injection of the analyte proteins. The only interactions detected for ZAZ3363 and ZAZ3422 were strong binding by hIL-17A and weaker binding by hIL-17A/F, as expected and in line with the results presented in Example 8. The analyte proteins were also assessed for their potential interaction with the ABD variant PEP07843, but no interactions were detected. Thus, the Z-ABD-Z polypeptides appear to be highly specific.

Example 13

Kinetic Measurements of Z-ABD-Z, IL-17A and HSA Complexes Using KinExA®

Technical limitations of SPR to accurately determine kinetic parameters for high affinity interactions and the higher complexity of determining the affinity between two dimeric targets by SPR warranted the use of Kinetic Exclusion Assay (KinExA®) technology to further analyze the binding of Z-ABD-Z polypeptides in complex with HSA to IL-17A, as well as the binding of Z-ABD-Z polypeptides alone, or in complex with IL-17A, to HSA. The KinExA® measures the equilibrium binding affinity and kinetics between unmodified molecules in solution phase (Darling and Brault, 2004. Assay and Drug Dev Tech 2(6):647-657)

Materials and Methods

The Z-ABD-Z polypeptides ZAZ3220 (SEQ ID NO:1236), ZAZ3363 (SEQ ID NO:1244) and ZAZ3422 (SEQ ID NO:1247), as well as HSA (Novozymes, cat. no. 230-005), human IL-17A (Peprotech, cat. no. 200-17), biotinylated (as described in Example 1) human IL-17A, mouse monoclonal anti-HSA antibody (Abcam, cat. no. 10241) and an in house produced goat polyclonal anti-Z antibody were sent to Sapidyne Instruments Inc (Boise, Id., USA) who performed the KinExA® measurements and analysis.

Binding of Z-ABD-Z/HSA to IL-17A:

For determination of the affinity, i.e. $K_D$, the respective Z-ABD-Z polypeptide, in complex with HSA, were used as a constant binding partner (CBP) and IL-17A was used as titrant. Data analysis was performed using the KinExA® Pro software and applying a least squares analysis to fit the optimal solutions for the $K_D$ and the Active Binding site Concentration (ABC) to a curve representative of a 1:1 reversible bi-molecular interaction.

For determination of $k_a$, the direct binding curve analysis was applied, using the same immobilized IL-17A as the capture reagent for kinetic experiments as for equilibrium experiments. The amount of free Z-ABD-Z/HSA in the sample was measured pre-equilibrium, yielding data points that monitored the decrease in free Z-ABD-Z/HSA as the sample moved toward equilibrium.

Binding of Z-ABD-Z and Z-ABD-Z/IL-17A to HSA:

The Z-ABD-Z polypeptide ZAZ3363 was further analyzed for binding to HSA in the presence or absence of IL-17A. For determination of $K_D$, ZAZ3363, free or in complex with IL-17A, was used as a constant binding partner (CBP) and HSA was used as titrant. Data analysis was performed using the KinExA® Pro software as described above.

For determination of $k_a$, the direct binding curve analysis was applied, using the same immobilized HSA as the capture reagent for kinetic experiments as for equilibrium experiments. The amount of ZAZ3363/IL-17A, in the sample was measured pre-equilibrium, yielding data points that monitored the decrease in free ZAZ3363/IL-17A as the sample moved toward equilibrium.

Results

In a first set of KinExA® measurements, the Z-ADB-Z polypeptides ZAZ3220, ZAZ3363 and ZAZ3422, respectively, in complex with HSA were shown to bind IL-17A with an exceptionally high affinity, with $K_D$ values in the subpicomolar to femtomolar range. The calculated kinetic parameters when assuming a monovalent binding between these Z-ABD-Z polypeptides and dimeric IL-17A are shown in Table 17.

In a second set of KinExA® measurements, the interaction between ZAZ3363, free or in complex with IL-17A, and HSA was measured. The calculated kinetic parameters from these analyses are shown in Table 18. The affinity of ZAZ3363 for HSA was not significantly affected by the presence of IL-17A.

To summarize, measurements using KinExA® technology indicated an exceptionally high affinity of Z-ABD-Z polypeptides for IL-17A. The measured $K_D$ of <0.33 µM is superior to the reported affinities for two of the clinically most advanced comparators secukinumab ($K_D$=122 µM; WO2006/013107 and WO2012/125680) and ixekizumab ($K_D$=2 µM; WO2007/070750). In addition, simultaneous binding to both IL-17A and albumin was demonstrated, i.e. both binding functions are intact in the Z-ABD-Z fusion protein.

TABLE 17

Kinetic parameters for Z-ABD-Z polypeptides binding to IL-17A

| CBP | SEQ ID NO | $ka^a$ [*] $(M^{-1}s^{-1})$ | kd $(s^{-1})$ | $K_D$ [*] (M) |
|---|---|---|---|---|
| ZAZ3220/HSA | 1236 | $1.35 \times 10^7$ [$1.25 \times 10^7$- $1.46 \times 10^7$] | $1.51 \times 10^{-7}$ | $<6.5 \times 10^{-14}$ [**] |

TABLE 17-continued

Kinetic parameters for Z-ABD-Z polypeptides binding to IL-17A

| CBP | SEQ ID NO | $ka^a$ [*] $(M^{-1}s^{-1})$ | kd $(s^{-1})$ | $K_D$ [*] (M) |
|---|---|---|---|---|
| ZAZ3363/HSA | 1244 | $4.78 \times 10^6$ [$5.64 \times 10^6$- $4.04 \times 10^6$] | $1.55 \times 10^{-6}$ | $3.23 \times 10^{-13}$ [$1.54 \times 10^{-13}$- $5.54 \times 10^{-13}$] |
| ZAZ3422/HSA | 1247 | $7.80 \times 10^6$ [$6.37 \times 10^6$- $9.56 \times 10^6$] | $6.08 \times 10^{-7}$ | $7.85 \times 10^{-14}$ [$1.63 \times 10^{-14}$- $1.73 \times 10^{-13}$] |

[*] 95% confidence interval
[**] 95% confidence interval for $K_D$ was not resolved

TABLE 18

Kinetic parameters for a Z-ABD-Z polypeptide binding to HSA

| CBP | SEQ ID NO | ka [*] $(M^{-1}s^{-1})$ | kd $(s^{-1})$ | $K_D$ [*] (M) |
|---|---|---|---|---|
| ZAZ3363 | 1244 | n.d. | n.d. | $4.85 \times 10^{-11}$ [$3.23 \times 10^{-11}$- $6.87 \times 10^{-11}$] |
| ZAZ3363/IL-17A | 1244 | $1.21 \times 10^6$ [$9.35 \times 10^5$- $1.50 \times 10^6$] | $3.56 \times 10^{-5}$ | $2.94 \times 10^{-11}$ [$1.72 \times 10^{-11}$- $4.64 \times 10^{-11}$] |

[*] 95% confidence interval

Example 14

Characterization of Z-ABD-Z Polypeptides in the NHDF Assay

Materials and Methods

Blocking of IL-17A Induced IL-6 Production in NHDF Assay:

NHDF cells (Lonza, cat. no. CC-2511) were cultured in fibroblast basal medium (Lonza, cat.no CC-3132) supplied with growth promoting factors (Lonza, cat.no. CC-5034). On the day before the experiment, 5000 cells per well were seeded into half area 96 well culture plates (Greiner, cat. no. 675180) in 100 µl. On the day of the experiment, dilutions of IL-17A specific Z-ABD-Z polypeptides with different linker lengths between the Z and ABD moieties (ZAZ3174 (SEQ ID NO:1233), ZAZ3175 (SEQ ID NO:1234), ZAZ3176 (SEQ ID NO:1235), ZAZ3220 (SEQ ID NO:1236), ZAZ3221 (SEQ ID NO:1237), ZAZ3234 (SEQ ID NO:1238), ZAZ3235 (SEQ ID NO:1239), ZAZ3236 (SEQ ID NO:1240), ZAZ3237 (SEQ ID NO:1241), ZAZ3269 (SEQ ID NO:1242) and ZAZ3270 (SEQ ID NO:1243)) were prepared in a separate 96-well plate. The Z-ABD-Z polypeptides were titrated in three-fold steps from 190 nM to 0.003 nM in medium containing 0.9 nM hIL-17A and 8 µM HSA. A standard IL-17A curve was also prepared (6.2-0.0001 nM), as well as controls containing medium with 0.9 nM IL-17A or medium alone. The medium in the plate with NHDF cells cultured overnight was discarded and 100 µl/well of the sample was transferred to the cell plate, which was placed in an incubator at 37° C. for 18-24 h. The next day, the IL-6 content in supernatants was quantified using IL-6 specific ELISA as described in Example 3. Additional Z-ABD-Z polypeptides (ZAZ3363 (SEQ ID NO:1244), ZAZ3364 (SEQ ID NO:1245), ZAZ3365 (SEQ ID NO:1246) and ZAZ3422 (SEQ ID NO:1247)) were analyzed in subsequent NHDF assays essentially as described above, but using an NHDF cell line from ATCC (cat. no. PSC-201-012). The blocking capacities of these Z-ABD-Z polypeptides were also analyzed after incubation of the polypeptides at 40° C. for 2 and 4 weeks.

Results

Z-ABD-Z polypeptides were investigated for their capacity to block IL-17A induced IL-6 production in the NHDF assay. First, it was seen that the Z-ABD-Z format increased the blocking capacity significantly compared to the monomeric $His_6$-Z format, as shown in FIG. 7A where inhibitory curves for $His_6$-Z10241 and ZAZ3220 (comprising Z10241) are displayed. The shape of the curve for ZAZ3220 suggests that the limit of detection for this cell assay is reached, with a one-to-one inhibition effect of the ZAZ3220, and it is likely that the Z-ABD-Z polypeptide has an even better inhibitory effect than can be appreciated from this experiment. It is contemplated that the potency of ZAZ3220 is increased to the assay limit due to the strong avidity effect obtained by binding the homodimeric IL-17A. Second, a comparison of Z-ABD-Z polypeptides with different linker lengths and comprising the Z variants Z06282 (SEQ ID NO:1206) and Z12876 (SEQ ID NO:1218) revealed that the length of the linker had a minor effect on the blocking capacity. A set of Z-ABD-Z polypeptides comprising Z06282 with different linker lengths is displayed in FIG. 7B. Additional Z-ABD-Z polypeptides, ZAZ3363, ZAZ3364, ZAZ3365 and ZAZ3422, were analyzed in subsequent NHDF assays, also after incubation of the Z-ABD-Z polypeptides at 40° C. for two and four weeks. The IL-17A inhibitory capacity was retained even after four weeks' incubation at 40° C. Calculated IC50 values, reflecting the capacity of different Z-ABD-Z polypeptides to inhibit IL-17A, are summarized in Table 19. These IC50 values are more than three-fold lower than the reported hIL-6 production neutralizing activity (IC50=2.1±0.1 nM) of the IL-17A inhibiting monoclonal antibody secukinumab, AIN457, (WO2006/013107 and WO2012/125680) currently in clinical development.

TABLE 19

Calculated IC50 values from NHDF assays

| Z-ABD-Z polypeptide | SEQ ID NO | Incubation at 40° C. (weeks) | IC50 (nM) |
|---|---|---|---|
| ZAZ3174 | 1233 | n.a. | 0.63 |
| ZAZ3175 | 1234 | n.a. | 0.56 |
| ZAZ3176 | 1235 | n.a. | 0.50 |
| ZAZ3220 | 1236 | n.a. | 0.27 |
| ZAZ3221 | 1237 | n.a. | 0.39 |
| ZAZ3234 | 1238 | n.a. | 0.66 |
| ZAZ3235 | 1239 | n.a. | 0.60 |
| ZAZ3236 | 1240 | n.a. | 0.54 |
| ZAZ3237 | 1241 | n.a. | 0.49 |
| ZAZ3269 | 1242 | n.a. | 0.42 |
| ZAZ3270 | 1243 | n.a. | 0.41 |
| ZAZ3363 | 1244 | 0 | 0.38 |
| ZAZ3363 | 1244 | 2 | 0.25 |
| ZAZ3363 | 1244 | 4 | 0.49 |
| ZAZ3364 | 1245 | 0 | 0.20 |
| ZAZ3364 | 1245 | 2 | 0.40 |
| ZAZ3364 | 1245 | 4 | 0.47 |
| ZAZ3365 | 1246 | 0 | 0.45 |
| ZAZ3365 | 1246 | 2 | 0.34 |
| ZAZ3365 | 1246 | 4 | 0.55 |
| ZAZ3422 | 1247 | 0 | 0.38 |
| ZAZ3422 | 1247 | 2 | 0.45 |
| ZAZ3422 | 1247 | 4 | 0.42 |

Example 15

In Vivo Neutralization of hIL-17A

Human IL-17A is able to bind to and stimulate the mouse IL-17 receptor, leading to elevation and subsequent secretion of mouse KC (CXCL1) chemokine.

Materials and Methods

In Vivo Neutralization of hIL-17A in the KC Mouse Model:

Dose ranging experiments were performed to identify the optimal dose of human IL-17A for induction of mouse KC. These experiments revealed that a 150 µg/kg dose of human IL-17A induced a suitable level of KC in mouse serum collected 2 h after IL-17A administration. ZAZ3174 (SEQ ID NO:1233) and ZAZ3220 (SEQ ID NO:1236) were analyzed in this model at two different occasions. In the first experiment, ZAZ3174 was administered s.c. to mice at three different doses; 0.25, 2.5 and 25 mg/kg, 9 h prior to a subcutaneous injection of human IL-17A. The mice were sacrificed 2 h post administration of human IL-17A, and KC levels were determined by ELISA using a commercially available kit according to the manufacturer's instruction (KC Quantikine; R&D Systems, cat no. D1700). In the second experiment, ZAZ3220 was administered s.c. to mice at three different doses, 0.05, 0.1, 0.4 mg/kg, 9 h prior to a subcutaneous injection of human IL-17A. The mice were sacrificed 2 h post administration of human IL-17A, and KC levels were determined by ELISA as above.

Results

Figure 8A:
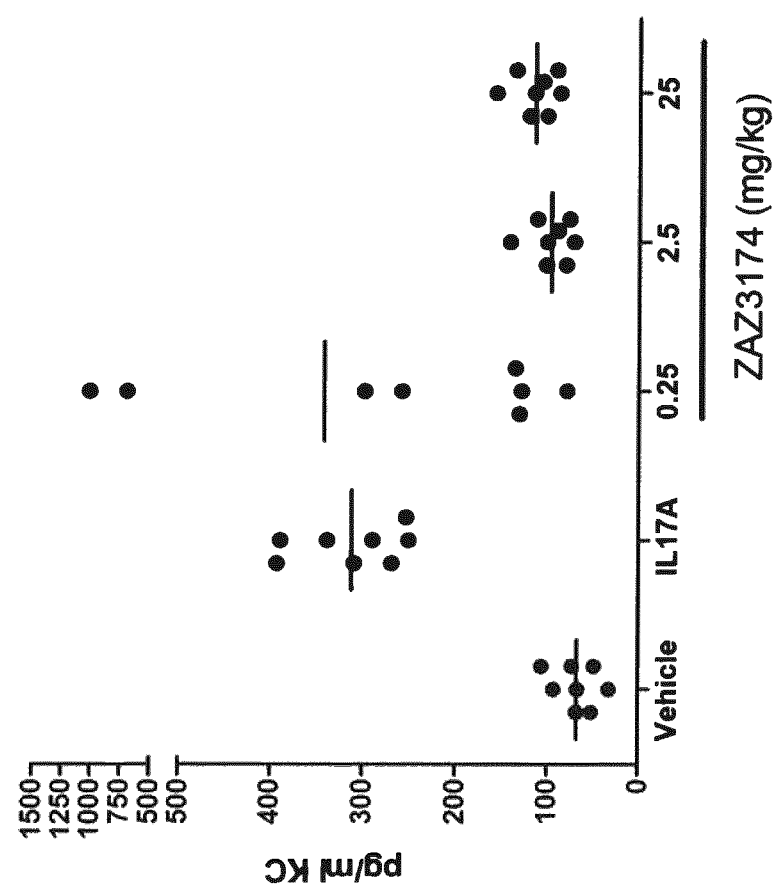
FIG. 8 shows dose dependent inhibition by Z-ABD-Z polypeptides in the hIL-17A induced KC-model described in Example 15. (A) Complete inhibition of KC production by ZAZ3174 (SEQ ID NO:1233) was obtained at a dose of 2.5 mg/kg. (B) Complete inhibition of KC production by ZAZ3220 (SEQ ID NO:1236) was obtained at a dose of 0.4 mg/kg. Doses indicated on the x-axis are given in mg/kg and the corresponding pmol dose. The numbers above the bar indicate percent inhibition in each dose group; 72% inhibition was obtained with 0.1 mg/kg ZAZ3220. LOQ=limit of quantification.
Figure 8B:
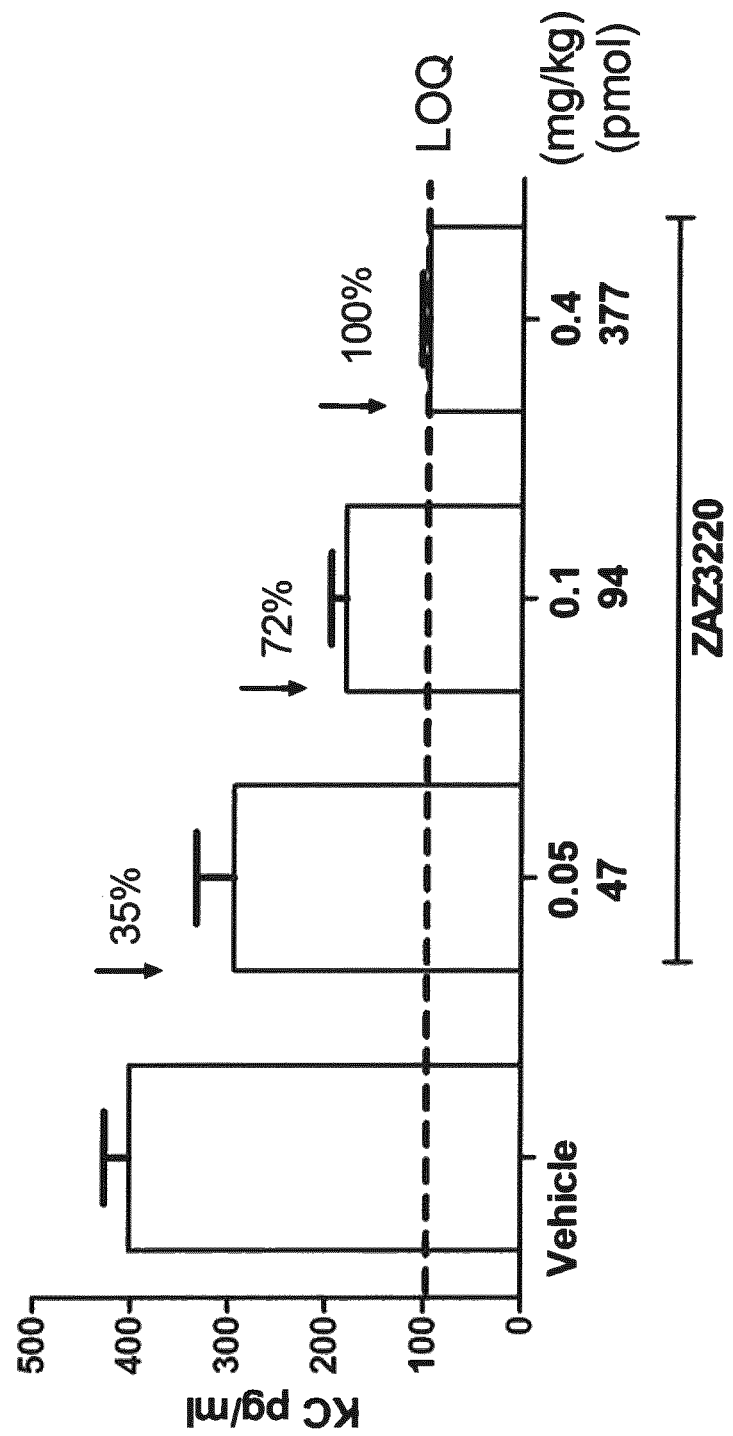

In Vivo Neutralization of hIL-17A in the KC Mouse Model:

The assayed Z-ABD-Z polypeptides block the ability of human IL-17A to stimulate the mouse IL-17 receptor, leading to inhibition of an elevation of mouse KC, in a dose dependent manner. ZAZ3174 at a dose of 2.5 mg/kg under the conditions described, blocked the induction of KC completely, as shown in FIG. 8A. The second experiment revealed that the Z-ABD-Z polypeptide ZAZ3220, comprising an affinity matured Z variant, blocked the IL-17A induced KC-response completely at a dose of 0.4 mg/kg (FIG. 8B). This corresponds to a 6-fold enhanced in vivo blocking effect compared to ZAZ3174. 72% inhibition was obtained with 0.1 mg/kg ZAZ3220.

Example 16

In Vivo Pharmacokinetics of Z-ABD-Z Polypeptides in Rats

This Example describes two separate experiments in which the pharmacokinetic parameters in rat were determined for two different Z-ABD-Z polypeptides following subcutaneous (s.c.) and/or intravenous (i.v.) injections.

Materials and Methods

In a first experiment, ZAZ3220 (SEQ ID NO:1236) formulated in PBS was administered i.v. (n=3) to Sprague Dawley (SD) male rats (Charles River, Germany) at a dose of 1.2 mg/kg corresponding to 57 nmol/kg. Blood samples were collected from the tail vein of each rat at time points 0.08, 8, 24, 48, 72, 120, 168, 240, 336, 408 and 504 h after administration.

In a second experiment, ZAZ3363 (SEQ ID NO:1244) formulated in PBS was administered i.v. (n=5) or s.c. (n=6) to SD male rats at a dose of 1.2 mg/kg corresponding to 64 nmol/kg. Blood samples were collected from the tail vein of each rat at time points 0, 0.08, 0.5, 1, 3, 8, 24, 72, 120, 168, 216, 264, 336, 408, 456 and 504 h post i.v. administration or at time points 0, 0.08, 0.5, 1, 3, 8, 24, 72, 120 and 168 h post s.c. administration.

Serum was prepared from the blood samples and stored at −20° C. until analysis. Quantification of ZAZ3220 and ZAZ3363 in serum from rats was performed using a PK-ELISA.

PK-ELISA:

96-well, half-area plates (50 μl/well) were coated with 4 μg/well of goat anti-Z Ig (produced in-house) in coating buffer (Sigma, cat.no. C3041) overnight at 4° C. The next day, the plates were blocked with PBS+0.5% casein for 1.5 h. Individual rat serum, minimally diluted 10× in PBS-casein+10% rat serum pool (assay matrix) was added to the plates and titrated in 2-fold dilution series. Included on one plate was standard of each Z-ABD-Z polypeptide (titrated between 300 ng/ml and 3 μg/ml) and on each plate four controls of each Z-ABD-Z polypeptide diluted to concentration within the linear range of the assay. Standard and controls were diluted in assay matrix. The diluted standard, controls and samples were prepared in separate plates and transferred to the coated ELISA plates. The plates were incubated for 1.5 h at RT followed by 1.5 h incubation with a custom made detection rabbit anti-ABD Ig (4 μg/ml, CUV002) and 1 h incubation with donkey anti-rabbit IgG-HRP (Jackson Immunoresearch, cat. no. 711-035-152). The reaction was developed with TMB (Thermo Fisher) and the development reaction was stopped after 15 min with 2 M $H_2SO_4$. The absorbance was read at 450 nm in an ELISA reader (Victor³, Perkin Elmer). The concentrations of the respective Z-ABD-Z variant in samples were calculated from the standard curve using GraphPad Prism5 and a four parameter logistic (4-PL) curve-fit.

Pharmacokinetic Analysis:

The pharmacokinetic analysis was based on individual rat serum concentration versus time. Terminal half-life (T½) and bioavailability was estimated using Microsoft Excel and GraphPad Prism and applying a two compartment model.

Results

Mean serum concentration-time profiles of the Z-ABD-Z polypeptides ZAZ3220 and ZAZ3363 following single administrations of 1.2 mg/kg to SD rats are shown in FIG. 9A and FIG. 9B, respectively, and the calculated pharmacokinetic parameters using a two-compartment analysis are summarized in Table 20. The estimated half-life (t½) was approximately 49 h for both ZAZ3220 and ZAZ3363 following i.v. administration. The t½ for ZAZ3363 administrated s.c. was 45 h and the bioavailability was calculated to 45%.

TABLE 20

Mean pharmacokinetic parameters of Z-ABD-Z polypeptides following a single i.v. or s.c. administration to SD rats

| Pharmakokinetic parameter | ZAZ3220 i.v. | ZAZ3363 i.v. | ZAZ3363 s.c. |
|---|---|---|---|
| Cmax (nmol/L) | 1905 | 1870 | 330 |
| Tmax (h) | 0.08 | 0.08 | 24 |
| $AUC_{0-t}$ (h*nmol/L) | 46369 | 42757 | 19351 |
| $t_{1/2}$ elimination (h) | 49 | 49 | 45 |
| MRT (h) | 35 | 33 | 47 |
| CL (L/h/kg) | 0.003 | 0.003 | 0.003 |
| F (%) | n.a. | n.a. | 45 |

Cmax: Peak serum concentration;
Tmax: Time to reach the peak serum concentration;
$AUC_{0-t}$: Area under the concentration-time curve from time zero to last quantifiable concentration;
$T_{1/2}$: Half-life;
MRT: Mean residence time;
CL: Clearance;
F: Percentage absolute bioavailability, calculated as F = [(Mean $AUC_{s.c.}$ × $Dose_{i.v.}$)/(Mean $AUC_{i.v.}$ × $Dose_{s.c.}$)] × 100

Example 17

Topical Administration of Z Variant to Eyes of Rabbits

Local administration to the eye is beneficial in ophthalmologic disorders, e.g. uveitis or dry eye diseases. Topical administration enables extremely high local drug concentrations with a minimal risk of systemic side effects. In this Example, the possibility to topically administer Z variant molecules to eyes was investigated in rabbits. The concentration of a Z variant molecule and a control IgG was measured in the anterior chamber (aqueous humor), in the vitreous humor and in serum after four repeated topical dosings.

Materials and Methods

Production of Z Variant:

The Z variant Z10199 (SEQ ID NO:1217) derived from Z06282 (SEQ ID NO:1206) but starting AE was subcloned without any tag but with the C-terminal addition of amino acid residues VD. Expression was performed essentially as described in Example 2, and purification was carried out by anion exchange and reverse phase chromatography. The sample was buffer exchanged to PBS pH 7.2 and endotoxins were removed using an EndoTrap® red 10 column (Hyglos).

Animal Study:

48 nmol (1 drop, 50 μl) of Z10199 and ZAZ3174 (SEQ ID NO:1233), respectively, was administered topically to each eye of rabbits (n=2 per molecule) at time points 0, 1, 2 and 3 hours. A control human IgG antibody (Xolair; Novartis) was administered in the same way to two different rabbits. As a negative control, one rabbit was administered PBS only. After each administration, the eyelids were held closed during approximately 30 s to keep the sample on the cornea. After 4 h, vitreous humor, aqueous humor and serum were collected. The samples were centrifuged to remove tissue debris and aggregates and the levels of Z10199, ZAZ3174 and antibody, respectively, were quantified by ELISA.

Quantification by ELISA:

The concentration of Z10199 and ZAZ3174, respectively, in the collected samples was analyzed by a sandwich ELISA using an in-house produced polyclonal goat anti-protein Z immunoglobulin for capture, an in-house produced polyclonal rabbit anti-protein Z immunoglobulin as primary antibody and goat anti-rabbit IgG-HRP (Dako cat. no. P0448) as secondary antibody. Detection was performed by incubation with ImmunoPure TMB for 15 min at RT and the reaction was stopped by addition of 2 M $H_2SO_4$. Absorption at 450 nm was measured with the microplate reader Victor³. The concentration of Z10199 was calculated from a standard curve prepared with the same molecule and using GraphPad prism5 and a non-linear regression formula.

The concentration of IgG in the collected samples was analyzed by an IgG ELISA kit (Abcam 100547) and performed as described by the manufacturer, using a standard curve provided and analysis by non-linear regression as above.

Results

Figure 10:
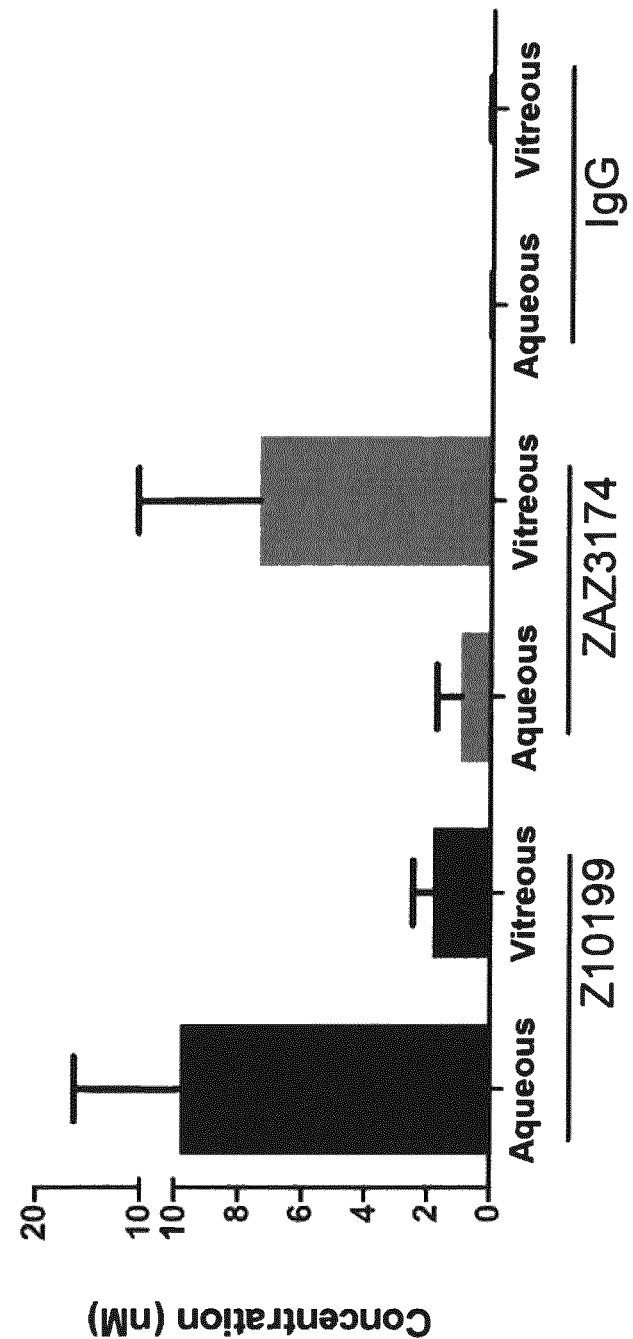
FIG. 10 shows the result of topical administration to the eyes of rabbits performed as described in Example 17. Uptake of Z variant Z10199 (SEQ ID NO:1217) and the Z-ABD-Z polypeptide ZAZ3174 (SEQ ID NO:1233) was demonstrated both in aqueous humor and vitreous humor, whereas the control IgG antibody did not penetrate the eye.

FIG. 10 shows that both Z10199 and ZAZ3174 penetrated the eye after topical administration and was present in aqueous and vitreous humor at low nM concentrations. In contrast, the control IgG antibody was not detected in either aqueous or vitreous humor. The serum samples could be regarded as negative for both the Z variant and IgG. Thus, the Z variant molecules of the present disclosure may be delivered by this alternative route of administration, which is not available to antibodies, and a local effect that avoids systemic exposure may be achieved.

Example 18

Pharmacokinetic Analysis of Duodenal Administration of ZAZ3363 Formulations in Rat Materials and Methods Test Item:

ZAZ3363 (SEQ ID NO:1244) was formulated in 1) OAF1: 0.12 M sodium chenodeoxycholate (Sigma, cat.no. C8261) and 0.12 M propyl gallate (Sigma, cat.no. P3130), pH 7.4; 2) OAF2: 50 mg/ml sodium caprate (Sigma, cat.no. 04151); or 3) 50 mM sodium phosphate (PBS), pH 7.0, at a concentration of 50 mg/ml (OAF1 and OAF2) or 100 mg/ml (PBS).

NHDF Cell Assay:

The activity of ZAZ3363 (SEQ ID NO:1244) formulated in OAF1, OAF2 or PBS was verified in the IL-17 dependent NHDF cell assay described in Example 14.

Duodenal Administration:

Male Sprague Dawley rats (Charles River) were anesthetized with isofluorane, and a small incision was made to localise the duodenum. An indwelling catheter (R-DUOD, AgnTho's, Sweden) was inserted surgically into the duodenum 20 mm from its origin in an area of minimal vasculature. The catheter was tunnelled subcutaneously to the back of the animals. Abdominal musculature was closed with sutures, while the abdominal skin incision and sub scapular exteriorization site was closed with stainless steel wound clips. The animals were left to recover for 5-6 days before being taken to the study. Post-operative analgesia was administered s.c. prior to surgery (carprofen 5 mg/kg and buprenorphine 0.05 mg/kg). Carprofen was administered once daily also on the two days following surgery. Additional doses of buprenorphine were administered when necessary. Antibiotics (enrofloxacin 0.3 mg/ml) was administered in the drinking water during the recovery period (3-5 days), as well as during the experiment. To mask the bitter taste of enrofloxacin, one piece of sugar was added to 500 ml of drinking water. To ensure a maintained patency, the duodenal catheter was flushed daily with sterile water (0.2-0.5 ml).

ZAZ3363 was administered directly into duodenum at a dose of 5.4 µmol/kg body weight formulated in OAF1 or OAF2 (n=2) or at 10.8 µmol/kg formulated in PBS (n=2) in a volume of 0.5 ml at time-point zero. Blood samples were taken under isoflurane anesthesia at 1, 3, 8, 24, 72, 120 and 168 h after administration and serum was prepared by standard procedures. The concentration of ZAZ3363 in serum was measured by the quantitative PK-ELISA described in Example 16, but titrating the standard of ZAZ3363 between 70 and 1 ng/ml.

Pharmacokinetic Analysis:

The pharmacokinetic analysis was based on individual rat serum concentration versus time. Terminal half-life (T½) and bioavailability was estimated using Microsoft Excel and GraphPad Prism.

Results

Activity of Formulated ZAZ3363:

The activity of ZAZ3363 formulated in OAF1 and OAF2, respectively, was compared to formulation in PBS in the NHDF cell assay. FIG. 11 shows the titration curves of OAF1 compared to PBS formulated ZAZ3363 (FIG. 11A) and OAF2 compared to PBS formulated ZAZ3363 (FIG. 11B). The experiment showed that the activity of ZAZ3363 in the two formulations was identical to PBS, i.e. the biological activity of ZAZ3363 was not affected by the different excipients.

Figure 12:
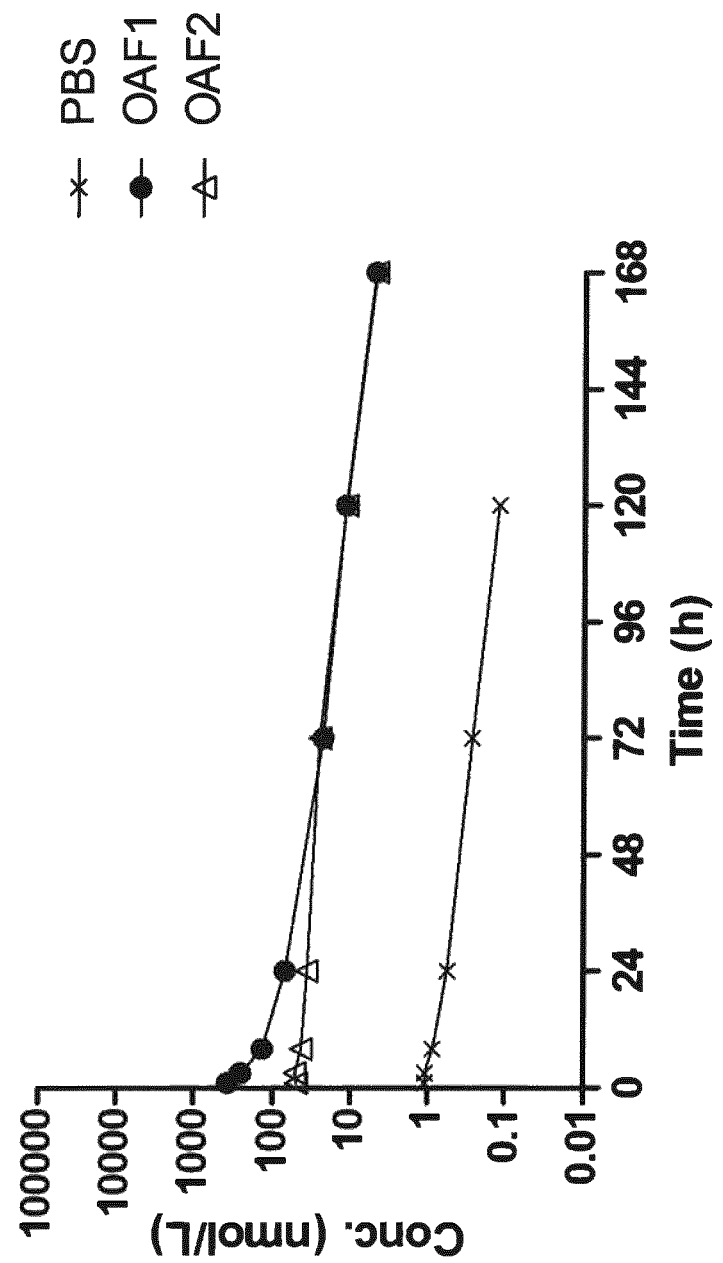
FIG. 12 shows the pharmacokinetic profile of intraduodenal administration of ZAZ3363 formulated in OAF1 (filled circles), OAF2 (open triangles) and PBS (crosses) performed as described in Example 18.

Intraduodenal Uptake of ZAZ3363:

Intestinal uptake of OAF1, OAF2 and PBS formulated ZAZ3363 was examined in a rat model of intraduodenal administration (i.d.). The experiment showed an increased uptake with OAF1 and OAF2 formulations compared to PBS (FIG. 12). The bioavailabilities were 0.2, 0.8 and 0.0007 for OAF1, OAF2 and PBS, respectively, as shown in Table 21. OAF2 formulated ZAZ3363 showed the best uptake, on average 1160 times better compared to formulation in PBS although great individual variation was seen. Formulation of ZAZ3363 in OAF1 was on average 260 times better than formulation in PBS.

TABLE 21

Bioavailability and T½ after intraduodenal administration of ZAZ3363 in three different formulations

| Formulation | T½ (h) | Bioavailability (%) |
|---|---|---|
| PBS | 43 | 0.0007 +/− 0.0002 |
| OAF1 | 43 | 0.2 +/− 0.02 |
| OAF2 | 50 | 0.8 +/− 1.2 |

Example 19

Characterization of Anti-IL-17A/Anti-TNF Complexes in the NHDF Assay

Materials and Methods

Production of Complexes and Control Antibody:

Two different complexes targeting IL-17A and TNF were constructed, as well as an antibody with affinity for TNF. The antibody denoted "Ada", having the same CDR sequences and specificity as the commercially available monoclonal antibody adalimumab, was constructed using the heavy chain (HC) and light chain (LC) sequences $HC_{Ada}$ (SEQ ID NO:1231) and $LC_{Ada}$ (SEQ ID NO:1232). The IL-17A targeting Z variant Z14253 (SEQ ID NO:1219) moiety was genetically fused, via a flexible 15 residue (GGGGS)$_3$ linker, to the C-termini of $HC_{Ada}$ or $LC_{Ada}$, resulting in the complexes $HC_{Ada}$-Z14253 and $LC_{Ada}$-Z14253, respectively. A schematic of the constructed complexes is shown in FIG. 13A. Gene synthesis, cloning, production by transient gene expression in CHO cells and purification using Protein A affinity chromatography was performed by Evitria AG (Switzerland).

Blocking of IL-17A Induced IL-6 Production in NHDF Assay:

The NHDF assay was performed essentially as described in Example 14, titrating the study samples $HC_{Ada}$-Z14253 and $LC_{Ada}$-Z14253 and their comparators in three-fold steps from 63 nM to 0.003 nM in a medium containing 0.9 nM rhIL-17A. The comparators were ZAZ3363 (SEQ ID NO:1244), the anti-TNF antibody Ada, as well as a negative control Z variant Z04726 (SEQ ID NO:1223, targeting taq polymerase) recombinantly fused to the ABD variant PP013 (SEQ ID NO:1224) via a VDSS linker (denoted Z04726-PP013), as described in Example 2. A standard IL-17A curve was also prepared (6.2-0.0001 nM) as well as controls containing medium with 0.9 nM IL-17A or medium alone. The IL-6 content in supernatants was quantified using the IL-6 specific ELISA described in Example 3.

Blocking of TNF or TNF/IL-17A Induced IL-8 Production in NHDF Assay:

NHDF (Lonza, cat.no. CC-2511) cells were cultured in fibroblast basal medium (Lonza, cat.no. CC-3132) supplied with growth promoting factors (Lonza, cat. no CC-5034). On the day before the experiment, 5000 cells per well were seeded into a half area 96 well culture plates (Greiner, cat.no 675180) in 100 µl. On the day of the experiment, dilutions of $HC_{Ada}$-Z14253 and $LC_{Ada}$-Z14253 and the comparators described above were prepared in a separate 96-well plate. The complexes and comparators were titrated in three-fold steps from 5 nM to 0.0007 nM in medium containing 0.1 nM human TNF (R&D Systems, cat. no. 2210-TA/CF) or a mixture of 0.05 nM and 0.1 nM rhIL-17A. Controls containing medium with 0.1 nM TNF or a mixture of 0.05 nM and 0.1 nM rhIL-17A or medium alone were also prepared. The medium in the plate with the overnight cultured NHDF cells was discarded and 100 µl/well of the sample was transferred to the cell plate. The plate was placed in an incubator at 37° C. for 18-24 h. The next day, the IL-8 content in supernatants was quantified using an IL-8 specific ELISA.

IL-8 ELISA:

IL-8 was quantified by a DuoSet ELISA kit (R&D systems, cat. no. DY208). Half area plates (Costar, cat.no. 3690) were coated with the anti-IL-8 capture antibody, 4 µg/ml in PBS, 50 µl/well, overnight at 4° C. On the day of the analysis, the plate was rinsed twice in tap water and then blocked with PBS+1% BSA for 2 h. IL-8 standard (R&D Systems, cat.no. 890806), titrated in a 2-fold dilution series (20-0.01 ng/ml) and supernatants from the cell assay plate were added to the coated ELISA plate (50 µl/well) and incubated for 1.5 h at RT. The plate was washed 4 times in an automated ELISA washer and 20 ng/ml (50 µl/well) of biotinylated anti-IL-8 detection antibody was added. After another 1 h incubation, the plate was washed and 50 µl of streptavidin-HRP (Thermo Fisher, cat. no. N100) diluted 8000× was added per well. The plate was developed after one additional hour's incubation and washing, with 50 µl TMB (Thermo Fisher, cat. no 34021) per well, and the reaction was stopped with 50 µl 2 M $H_2SO_4$. The absorbances were read in a multi label reader (Victor$^3$, Perkin Elmer).

Results

Blocking of IL-17A Induced IL-6 Production in NHDF Assay:

The two complexes $HC_{Ada}$-Z14253 and $LC_{Ada}$-Z14253 were studied with regard to their capacity to block IL-17A induced IL-6 production in the NHDF assay. Results from the NHDF assay are presented in FIG. 13B. Both $HC_{Ada}$-Z14253 and $LC_{Ada}$-Z14253 has a similar capacity to block IL-17A as ZAZ3363. As expected, no inhibition was seen for Ada or the negative control Z04726-PP013.

Blocking of TNF or TNF/IL-17A Induced IL-8 Production in NHDF Assay:

The two complexes $HC_{Ada}$-Z14253 and $LC_{Ada}$-Z14253 were studied with regard to their capacity to block TNF or a mixture of TNF/IL-17A induced IL-8 production in the NHDF assay. Results from the NHDF assay showed that $HC_{Ada}$-Z14253 and $LC_{Ada}$-Z14253 have similar inhibitory profiles as the anti-TNF antibody Ada with regard to specific TNF blocking capacity (FIG. 13C). However, $HC_{Ada}$-Z14253 and $LC_{Ada}$-Z14253 had superior inhibitory profiles compared to Ada and ZAZ3363 in the combination assay, where the blocking effect to both TNF and IL-17 was investigated (FIG. 13D).

Example 20

In Vivo Pharmacokinetics of Z-ABD-Z Polypeptide in Monkeys

This Example describes a repeated dose study conducted over 10 days in cynomolgus monkeys administered with the Z-ABD-Z polypeptide ZAZ3363. The results were used for estimation of the half-life of ZAZ3363 in cynomolgus.

Materials and Methods

ZAZ3363 (SEQ ID NO:1244) was administered at 20 mg/kg (n=2; 1 male and 1 female) and 40 mg/kg (n=4; 2 male and 2 female) as a short i.v. infusion on days 1, 4, 7 and 10. Plasma samples for determination of ZAZ3363 concentration were collected in connection with the first dose on day 1 (at time points 0 (pre-dose), 5 min, 0.5, 1, 2, 6, 24 and 48 h after administration) and last dose on day 10 (at time points 0 (pre-dose), 5 min, 0.5, 1, 2, 6, 24, 48 h, 5, 7, 10, 12, 14 and 21 days after administration). Quantification of ZAZ3363 in plasma samples was carried out by LC-MS/MS based on peptides obtained after tryptic digestion of ZAZ3363. Concentration-time profiles were evaluated using both non-compartmental methods with separate analyses for day 1 and day 10 and compartmental methods evaluating the data for day 1 and day 10 combined for each animal.

Results

Mean plasma concentration-time profiles of ZAZ3363 following administration on day 1 and day 10 are shown in FIG. 14A and FIG. 14B, respectively. Despite the fact that ZAZ3363 was not administered as a single dose with full PK evaluation, the available results after multiple dosing allows for a prediction of the concentration-time profile after single doses. The plasma concentrations decreased in two phases according to a two-compartment behavior. The t½ of the second phase estimated from this and a second repeated dose study (data not shown) was approximately 4-7.5 days, which is in agreement with the reported t½ for monkey albumin (Deo et al., 1974, J Nutr 104:858-64). No significant gender differences were observed.

Example 21

Oral Administration of Z-ABD-Z Polypeptide in Dogs

Materials and Methods

Preparation of Capsules:

ZAZ3363 (SEQ ID NO:1244) was formulated in OAF1 (see Example 18) at a concentration of 100 mg/ml. The formulation was lyophilized and filled in hard shell capsules subsequently enteric coated (performed by Catalent Pharma Solutions, Beinheim, France). Each capsule contained approximately 25 mg ZAZ3363.

Animal Study:

The animal study was performed at Huntingdon Life Science (Cambridgeshire, UK). Fasted beagle dogs (n=3; female individuals) each received six capsules containing ZAZ3363 (approximately 150 mg). Serum samples were taken at 0.5, 1, 2, 4, 6, 8, 12, 24 and 96 h after administration.

Quantification:

The concentration of ZAZ3363 in serum samples was quantified using a PK sandwich ELISA essentially as described in Example 16, but using an in-house produced monoclonal anti-Z IgG in the first coating step.

Results

Figure 15:
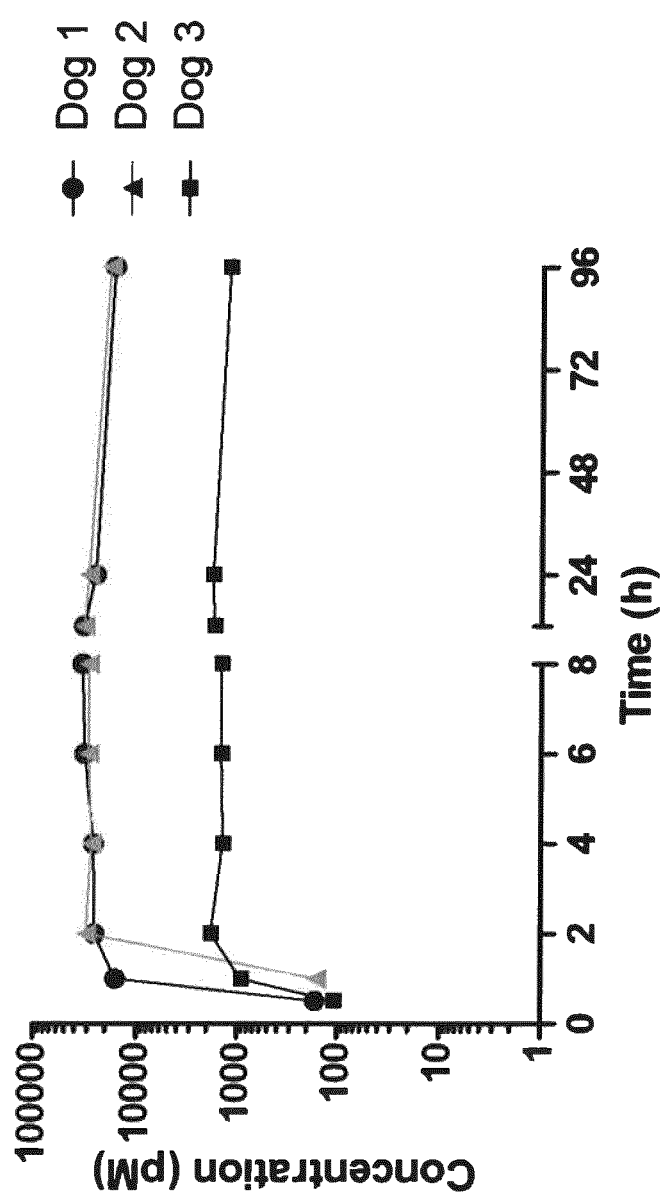
FIG. 15 shows the pharmacokinetic profiles of the Z-ABD-Z polypeptide ZAZ3363 (SEQ ID NO:1244) in individual beagle dogs following oral administration. 150 mg of ZAZ3363 was administered as enteric coated capsules on day 0.

The individual dog serum concentrations versus time profiles of ZAZ3363 are shown in FIG. 15. The results showed intestinal uptake of ZAZ3363 in all three animals, but with some variation between individuals. The ZAZ3363 serum concentration reached a maximum of 2-30 nM. Once in the circulation, the serum levels of ZAZ3363 remains stable at least up to 96 h, which is ascribed the interaction with dog albumin of the ABD moiety PP013 (SEQ ID NO:1223) within ZAZ3363. The ability of PP013 to bind dog albumin has been demonstrated previously (WO2012/004384).

ITEMIZED LISTING OF EMBODIMENTS

1. IL-17A binding polypeptide, comprising an IL-17A binding motif BM, which motif consists of an amino acid sequence selected from:

i) $EX_2DX_4AX_6X_7EIX_{10}X_{11}LPNL\ X_{16}X_{17}X_{18}QX_{20}X_{21}AFIX_{25}\ X_{26}LX_{28}X_{29}$ wherein, independently from each other, $X_2$ is selected from A, H, M and Y;
$X_4$ is selected from A, D, E, F, K, L, M, N, Q, R, S and Y;
$X_6$ is selected from A, Q and W;
$X_7$ is selected from F, I, L, M, V, W and Y;
$X_{10}$ is selected from A and W;
$X_{11}$ is selected from A, D, E, F, G, L, M, N, Q, S, T and Y;
$X_{16}$ is selected from N and T;
$X_{17}$ is selected from H, W and Y;
$X_{18}$ is selected from A, D, E, H and V;
$X_{20}$ is selected from A, G, Q, S and W;
$X_{21}$ is selected from A, D, E, F, H, K, N, R, T, V, W and Y;
$X_{25}$ is selected from A, D, E, G, H, I, L, M, N, Q, R, S, T and V;
$X_{26}$ is selected from K and 5,
$X_{28}$ is selected from I, L, N and R; and
$X_{29}$ is selected from D and R;

and ii) an amino acid sequence which has at least 89% identity to the sequence defined in i).

2. IL-17A binding polypeptide according to item 1, wherein, in sequence i), $X_2$ is selected from A, H and M;
$X_4$ is selected from A, D, E, F, L, M, N, Q, R and Y;
$X_{11}$ is selected from A, D, E, F, G, L, M, N, S, T and Y;
$X_{18}$ is selected from A, D, E and V;
$X_{20}$ is selected from A, G, Q and W;
$X_{21}$ is selected from E, F, H, N, R, T, V, W and Y;
$X_{25}$ is selected from A, D, E, G, H, I, L, N, Q, R, S, T and V; and
$X_{28}$ is selected from I, N and R.

3. IL-17A binding polypeptide according to item 2, wherein, in sequence i), $X_{16}$ is T;
$X_{17}$ is W,
$X_{21}$ is selected from E, F, H, W, T and Y;
$X_{25}$ is selected from A, D, E, G, H, I, L, N, Q, R, S and T;
$X_{26}$ is K; and
$X_{29}$ is D.

4. IL-17A binding polypeptide according to any preceding item, wherein sequence i) fulfills at least six of the eleven conditions I-XI:

I. $X_2$ is A;
II. $X_4$ is selected from D, E and Q;
III. $X_6$ is A;
IV. $X_7$ is selected from F and V;
V. $X_{16}$ is T;
VI. $X_{17}$ is W;
VII. $X_{18}$ is selected from A and D;
VIII. $X_{20}$ is W;
IX. $X_{26}$ is K;
X. $X_{28}$ is R; and
XI. $X_{29}$ is D.

5. IL-17A binding polypeptide according to item 4, wherein sequence i) fulfills at least seven of the eleven conditions I-XI.

6. IL-17A binding polypeptide according to item 5, wherein sequence i) fulfills at least eight of the eleven conditions I-XI.

7. IL-17A binding polypeptide according to item 6, wherein sequence i) fulfills at least nine of the eleven conditions I-XI.

8. IL-17A binding polypeptide according to item 7, wherein sequence i) fulfills at least ten of the eleven conditions I-XI.

9. IL-17A binding polypeptide according to item 8, wherein sequence i) fulfills all of the eleven conditions I-XI.

10. IL-17A binding polypeptide according to any preceding item, wherein $X_2X_6$, $X_2X_{10}$ or $X_6X_{10}$ is AA.

11. IL-17A binding polypeptide according to any preceding item, wherein $X_2X_{17}$, $X_2X_{20}$, $X_6X_{17}$, $X_6X_{20}$, $X_{10}X_{17}$ or $X_{10}X_{20}$ is AW.

12. IL-17A binding polypeptide according to any preceding item, wherein $X_2X_{28}$, $X_6X_{28}$ or $X_{10}X_{28}$ is AR.

13. IL-17A binding polypeptide according to any preceding item, wherein $X_{17}X_{28}$ or $X_{20}X_{28}$ is WR.

14. IL-17A binding polypeptide according to any preceding item, wherein $X_{17}X_{20}$ is WW.

15. IL-17A binding polypeptide according to any preceding item, wherein sequence i) is the sequence from position 8 to position 36 in a sequence selected from the group consisting of SEQ ID NO:1-1216.

16. IL-17A binding polypeptide according to item 15, wherein sequence i) is the sequence from position 8 to position 36 in a sequence selected from the group consisting of SEQ ID NO:1-66, 1200, 1206 and 1214.

17. IL-17A binding polypeptide according to item 16, wherein sequence i) is the sequence from position 8 to position 36 in a sequence selected from the group consisting of SEQ ID NO:1-66.

18. IL-17A binding polypeptide according to item 17, wherein sequence i) is the sequence from position 8 to position 36 in a sequence selected from the group consisting of SEQ ID NO:1-35.

19. IL-17A binding polypeptide according to item 18, wherein sequence i) is the sequence from position 8 to position 36 in a sequence selected from the group consisting of SEQ ID NO:1-27.

20. IL-17A binding polypeptide according to item 19, wherein sequence i) is the sequence from position 8 to position 36 in a sequence selected from the group consisting of SEQ ID NO:1-10.

21. IL-17A binding polypeptide according to item 20, wherein sequence i) is the sequence from position 8 to position 36 in a sequence selected from the group consisting of SEQ ID NO:1-7.

22. IL-17A binding polypeptide according to item 21, wherein sequence i) is the sequence from position 8 to position 36 in a sequence selected from the group consisting of SEQ ID NO:1-4.

23. IL-17A binding polypeptide according to item 22, wherein sequence i) is the sequence from position 8 to position 36 in SEQ ID NO:1.

24. IL-17A binding polypeptide according to any preceding item, wherein said IL-17A binding motif forms part of a three-helix bundle protein domain.

25. IL-17A binding polypeptide according to item 24, wherein said IL-17A binding motif essentially forms part of two helices with an interconnecting loop, within said three-helix bundle protein domain.

26. IL-17A binding polypeptide according to item 25, wherein said three-helix bundle protein domain is selected from bacterial receptor domains.

27. IL-17A binding polypeptide according to item 26, wherein said three-helix bundle protein domain is selected from domains of protein A from *Staphylococcus aureus* or derivatives thereof.

28. IL-17A binding polypeptide according to any preceding item, which comprises an amino acid sequence binding module, BMod, selected from:

iii) K-[BM]-1DPSQS $X_aX_b$LL$X_c$ EAKKL $X_dX_eX_f$Q;

wherein

[BM] is an IL-17A binding motif as defined in any one of items 1-23 provided that $X_{29}$ is D;

$X_a$ is selected from A and S;

$X_b$ is selected from N and E;

$X_c$ is selected from A, S and C;

$X_d$ is selected from E, N and S;

$X_e$ is selected from D, E and S;

$X_f$ is selected from A and S; and iv) an amino acid sequence which has at least 85% identity to a sequence defined by iii).

29. IL-17A binding polypeptide according to any one of items 1-27, which comprises an amino acid sequence binding module, BMod, selected from:

v) K-[BM]-QPEQS $X_aX_b$LL$X_c$ EAKKL $X_dX_eX_f$Q;

wherein

[BM] is an IL-17A binding motif as defined in any one of items 1-23 provided that $X_{29}$ is R;

$X_a$ is selected from A and S;

$X_b$ is selected from N and E;

$X_c$ is selected from A, S and C;

$X_d$ is selected from E, N and S;

$X_e$ is selected from D, E and S;

$X_f$ is selected from A and S; and vi) an amino acid sequence which has at least 85% identity to a sequence defined by v).

30. IL-17A binding polypeptide according to item 28 or 29, wherein $X_a$ in sequence iii) or v) is A.

31. IL-17A binding polypeptide according to item 28 or 29, wherein $X_a$ in sequence iii) or v) is S.

32. IL-17A binding polypeptide according to any one of items 28-31, wherein $X_b$ in sequence iii) or v) is N.

33. IL-17A binding polypeptide according to any one of items 28-31, wherein $X_b$ in sequence iii) or v) is E.

34. IL-17A binding polypeptide according to any one of items 28-33, wherein $X_c$ in sequence iii) or v) is A.

35. IL-17A binding polypeptide according to any one of items 28-33, wherein $X_c$ in sequence iii) or v) is S.

36. IL-17A binding polypeptide according to any one of items 28-33, wherein $X_c$ in sequence iii) or v) is C.

37. IL-17A binding polypeptide according to any one of items 28-36, wherein $X_d$ in sequence iii) or v) is E.

38. IL-17A binding polypeptide according to any one of items 28-36, wherein $X_d$ in sequence iii) or v) is N.

39. IL-17A binding polypeptide according to any one of items 28-36, wherein $X_d$ in sequence iii) or v) is S.

40. IL-17A binding polypeptide according to any one of items 28-39, wherein $X_e$ in sequence iii) or v) is D.

41. IL-17A binding polypeptide according to any one of items 28-39, wherein $X_e$ in sequence iii) or v) is E.

42. IL-17A binding polypeptide according to any one of items 28-39, wherein $X_e$ in sequence iii) or v) is S.

43. IL-17A binding polypeptide according to any one of items 37 and 39-42, wherein $X_dX_e$ in sequence iii) or v) is selected from EE, ES, SD, SE and SS.

44. IL-17A binding polypeptide according to item 43, wherein $X_dX_e$ in sequence iii) or v) is ES.

45. IL-17A binding polypeptide according to item 43, wherein $X_dX_e$ in sequence iii) or v) is SE. 46. IL-17A binding polypeptide according to item 43, wherein $X_dX_e$ in sequence iii) or v) is SD.

47. IL-17A binding polypeptide according to any one of items 28-46, wherein $X_f$ in sequence iii) or v) is A.

48. IL-17A binding polypeptide according to any one of items 28-46, wherein $X_f$ in sequence iii) or v) is S.

49. IL-17A binding polypeptide according to item 28 or 29, wherein, in sequence iii) or v), $X_a$ is A; $X_b$ is N; $X_c$ is A and $X_f$ is A.

50. IL-17A binding polypeptide according to item 28 or 29, wherein, in sequence iii) or v), $X_a$ is S; $X_b$ is E; $X_c$ is A and $X_f$ is A.

51. IL-17A binding polypeptide according to item 28 or 29, wherein, in sequence iii) or v), $X_a$ is A; $X_b$ is N; $X_c$ is C and $X_f$ is A.

52. IL-17A binding polypeptide according to item 28 or 29, wherein, in sequence iii) or v), $X_a$ is S; $X_b$ is E; $X_c$ is S and $X_f$ is S.

53. IL-17A binding polypeptide according to item 28 or 29, wherein, in sequence iii) or v), $X_a$ is S; $X_b$ is E; $X_c$ is S and $X_f$ is A.

54. IL-17A binding polypeptide according to item 28 or 29, wherein, in sequence iii) or v), $X_a$ is S; $X_b$ is E; $X_c$ is A and $X_f$ is S.

55. IL-17A binding polypeptide according to item 28 or 29, wherein, in sequence iii) or v), $X_a$ is S; $X_b$ is E; $X_c$ is C and $X_f$ is S.

56. IL-17A binding polypeptide according to item 49, wherein, in sequence iii) or v), $X_a$ is A; $X_b$ is N; $X_c$ is A; $X_dX_e$ is ND and $X_f$ is A.

57. IL-17A binding polypeptide according to item 50, wherein, in sequence iii) or v), $X_a$ is S; $X_b$ is E; $X_c$ is A; $X_dX_e$ is ND and $X_f$ is A.

58. IL-17A binding polypeptide according to item 51, wherein, in sequence iii) or v), $X_a$ is A; $X_b$ is N; $X_c$ is C; $X_dX_e$ is ND and $X_f$ is A.

59. IL-17A binding polypeptide according to item 52, wherein, in sequence iii) or v), $X_a$ is S, $X_b$ is E; $X_c$ is S, $X_dX_e$ is ND and $X_f$ is S.

60. IL-17A binding polypeptide according to item 53, wherein, in sequence iii) or v), $X_a$ is S; $X_b$ is E; $X_c$ is S, $X_dX_e$ is ND and $X_f$ is A.

61. IL-17A binding polypeptide according to item 55, wherein, in sequence iii) or v), $X_a$ is S, $X_b$ is E; $X_c$ is C; $X_dX_e$ is ND and $X_f$ is S.

62. IL-17A binding polypeptide according to item 49, wherein, in sequence iii) or v), $X_a$ is A; $X_b$ is N; $X_c$ is A; $X_dX_e$ is SE and $X_f$ is A.

63. IL-17A binding polypeptide according to item 50, wherein, in sequence iii) or v), $X_a$ is S; $X_b$ is E; $X_c$ is A; $X_dX_e$ is SE and $X_f$ is A.

64. IL-17A binding polypeptide according to item 51, wherein, in sequence iii) or v), $X_a$ is A; $X_b$ is N; $X_c$ is C; $X_dX_e$ is SE and $X_f$ is A.

65. IL-17A binding polypeptide according to item 52, wherein, in sequence iii) or v), $X_a$ is S, $X_b$ is E; $X_c$ is S, $X_dX_e$ is SE and $X_f$ is S.

66. IL-17A binding polypeptide according to item 54, wherein, in sequence iii) or v), $X_a$ is S; $X_b$ is E; $X_c$ is A; $X_dX_e$ is SE and $X_f$ is S.

67. IL-17A binding polypeptide according to item 55, wherein, in sequence iii) or v), $X_a$ is S, $X_b$ is E; $X_c$ is C; $X_dX_e$ is SE and $X_f$ is S.

68. IL-17A binding polypeptide according to item 49, wherein, in sequence iii) or v), $X_a$ is A; $X_b$ is N; $X_c$ is A; $X_dX_e$ is ES and $X_f$ is A.

69. IL-17A binding polypeptide according to item 50, wherein, in sequence iii) or v), $X_a$ is S; $X_b$ is E; $X_c$ is A; $X_dX_e$ is ES and $X_f$ is A.

70. IL-17A binding polypeptide according to item 51, wherein, in sequence iii) or v), $X_a$ is A; $X_b$ is N; $X_c$ is C; $X_dX_e$ is ES and $X_f$ is A.

71. IL-17A binding polypeptide according to item 52, wherein, in sequence iii) or v), $X_a$ is S; $X_b$ is E; $X_c$ is S, $X_dX_e$ is ES and $X_f$ is S.

72. IL-17A binding polypeptide according to item 55, wherein, in sequence iii) or v), $X_a$ is S, $X_b$ is E; $X_c$ is C; $X_dX_e$ is ES and $X_f$ is S.

73. IL-17A binding polypeptide according to item 49, wherein, in sequence iii) or v), $X_a$ is A; $X_b$ is N; $X_c$ is A; $X_dX_e$ is SD and $X_f$ is A.

74. IL-17A binding polypeptide according to item 50, wherein, in sequence iii) or v), $X_a$ is S; $X_b$ is E; $X_c$ is A; $X_dX_e$ is SD and $X_f$ is A.

75. IL-17A binding polypeptide according to item 51, wherein, in sequence iii) or v), $X_a$ is A; $X_b$ is N; $X_c$ is C; $X_dX_e$ is SD and $X_f$ is A.

76. IL-17A binding polypeptide according to item 52, wherein, in sequence iii) or v), $X_a$ is S; $X_b$ is E; $X_c$ is S, $X_dX_e$ is SD and $X_f$ is S.

77. IL-17A binding polypeptide according to item 54, wherein, in sequence iii) or v), $X_a$ is S, $X_b$ is E; $X_c$ is A; $X_dX_e$ is SD and $X_f$ is S.

78. IL-17A binding polypeptide according to item 55, wherein, in sequence iii) or v), $X_a$ is S, $X_b$ is E; $X_c$ is C; $X_dX_e$ is SD and $X_f$ is S.

79. IL-17A binding polypeptide according to item 28, wherein said sequence iii) is the sequence from position 7 to position 55 in a sequence selected from the group consisting of SEQ ID NO:1-1216.

80. IL-17A binding polypeptide according to item 79, wherein sequence iii) is the sequence from position 7 to position 55 in a sequence selected from the group consisting of SEQ ID NO:1-66, 1200, 1206 and 1214.

81. IL-17A binding polypeptide according to item 80, wherein sequence iii) is the sequence from position 7 to position 55 in a sequence selected from the group consisting of SEQ ID NO:1-66.

82. IL-17A binding polypeptide according to item 81, wherein sequence iii) is the sequence from position 7 to position 55 in a sequence selected from the group consisting of SEQ ID NO:1-35.

83. IL-17A binding polypeptide according to item 82, wherein sequence iii) is the sequence from position 7 to position 55 in a sequence selected from the group consisting of SEQ ID NO:1-27.

84. IL-17A binding polypeptide according to item 83, wherein sequence iii) is the sequence from position 7 to position 55 in a sequence selected from the group consisting of SEQ ID NO:1-10.

85. IL-17A binding polypeptide according to item 84, wherein sequence iii) is the sequence from position 7 to position 55 in a sequence selected from the group consisting of SEQ ID NO:1-7.

86. IL-17A binding polypeptide according to item 85, wherein sequence iii) is the sequence from position 7 to position 55 in a sequence selected from the group consisting of SEQ ID NO:1-4.

87. IL-17A binding polypeptide according to item 86, wherein sequence iii) the sequence from position 7 to position 55 in SEQ ID NO:1.

88. IL-17A binding polypeptide according to any preceding item, which comprises an amino acid sequence selected from:
vii) YA-[BMod]-AP;
wherein [BMod] is an IL-17A binding module as defined in any one of items 28-87; and
viii) an amino acid sequence which has at least 86% identity to a sequence defined by vii).

89. IL-17A binding polypeptide according to any one of items 1-87, which comprises an amino acid sequence selected from:
ix) FA-[BMod]-AP;
wherein [BMod] is an IL-17A binding module as defined in any one of items 28-87; and
x) an amino acid sequence which has at least 86% identity to a sequence defined by ix).

90. IL-17A binding polypeptide according to any one of items 1-87, which comprises an amino acid sequence selected from:
xi) FN-[BMod]-AP;
wherein [BMod] is an IL-17A binding module as defined in any one of items 28-87; and
xii) an amino acid sequence which has at least 86% identity to a sequence defined by xi).

91. IL-17A binding polypeptide according to any preceding item, which comprises an amino acid sequence selected from:

| SEQ ID NO: | |
|---|---|
| 1250 | ADNNFNK-[BM]-DPSQSANLLSEAKKLNESQAPK; |
| 1251 | ADNKFNK-[BM]-DPSQSANLLAEAKKLNDAQAPK; |
| 1252 | ADNKFNK-[BM]-DPSVSKEILAEAKKLNDAQAPK; |
| 1253 | ADAQQNNFNK-[BM]-DPSQSTNVLGEAKKLNESQAPK; |

| SEQ ID NO: | |
|---|---|
| 1254 | AQHDE-[BM]-DPSQSANVLGEAQKLNDSQAPK; |
| 1255 | VDNKFNK-[BM]-DPSQSANLLAEAKKLNDAQAPK; |
| 1256 | AEAKYAK-[BM]-DPSESSELLSEAKKLNKSQAPK; |
| 1257 | VDAKYAK-[BM]-DPSQSSELLAEAKKLNDAQAPK; |
| 1258 | VDAKYAK-[BM]-DPSQSSELLAEAKKLNDSQAPK; |
| 1259 | AEAKYAK-[BM]-DPSQSSELLSEAKKLNDSQAPK; |
| 1260 | AEAKYAK-[BM]-DPSQSSELLSEAKKLNDSQAP; |
| 1261 | AEAKYAK-[BM]-DPSQSSELLSEAKKLNDAQAPK; |
| 1262 | AEAKYAK-[BM]-DPSQSSELLSEAKKLNDAQAP; |
| 1263 | AEAKFAK-[BM]-DPSQSSELLSEAKKLNDSQAPK; |
| 1264 | AEAKFAK-[BM]-DPSQSSELLSEAKKLNDSQAP; |
| 1265 | AEAKYAK-[BM]-DPSQSSELLAEAKKLNDAQAPK; |
| 1266 | AEAKYAK-[BM]-DPSQSSELLSEAKKLSESQAPK; |
| 1267 | AEAKYAK-[BM]-DPSQSSELLSEAKKLSESQAP; |
| 1268 | AEAKFAK-[BM]-DPSQSSELLSEAKKLSESQAPK; |
| 1269 | AEAKFAK-[BM]-DPSQSSELLSEAKKLSESQAP; |
| 1270 | AEAKYAK-[BM]-DPSQSSELLAEAKKLSEAQAPK; |
| 1271 | AEAKYAK-[BM]-QPEQSSELLSEAKKLSESQAPK; |
| 1272 | AEAKYAK-[BM]-DPSQSSELLSEAKKLESSQAPK; |
| 1273 | AEAKYAK-[BM]-DPSQSSELLSEAKKLESSQAP; |
| 1274 | AEAKYAK-[BM]-DPSQSSELLAEAKKLESAQAPK; |
| 1275 | AEAKYAK-[BM]-QPEQSSELLSEAKKLESSQAPK; |
| 1276 | AEAKYAK-[BM]-DPSQSSELLSEAKKLSDSQAPK; |
| 1277 | AEAKYAK-[BM]-DPSQSSELLSEAKKLSDSQAP; |
| 1278 | AEAKYAK-[BM]-DPSQSSELLAEAKKLSDSQAPK; |
| 1279 | AEAKYAK-[BM]-DPSQSSELLAEAKKLSDAQAPK; |
| 1280 | AEAKYAK-[BM]-QPEQSSELLSEAKKLSDSQAPK; |
| 1281 | VDAKYAK-[BM]-DPSQSSELLSEAKKLNDSQAPK; |
| 1282 | VDAKYAK-[BM]-DPSQSSELLSEAKKLSESQAPK; |
| 1283 | VDAKYAK-[BM]-DPSQSSELLAEAKKLSEAQAPK; |
| 1284 | VDAKYAK-[BM]-QPEQSSELLSEAKKLSESQAPK; |
| 1285 | VDAKYAK-[BM]-DPSQSSELLSEAKKLESSQAPK; |
| 1286 | VDAKYAK-[BM]-DPSQSSELLAEAKKLESAQAPK; |
| 1287 | VDAKYAK-[BM]-QPEQSSELLSEAKKLESSQAPK; |
| 1288 | VDAKYAK-[BM]-DPSQSSELLSEAKKLSDSQAPK; |
| 1289 | VDAKYAK-[BM]-DPSQSSELLAEAKKLSDSQAPK; |
| 1290 | VDAKYAK-[BM]-DPSQSSELLAEAKKLSDAQAPK; |
| 1291 | VDAKYAK-[BM]-QPEQSSELLSEAKKLSDSQAPK; |
| 1292 | VDAKYAK-[BM]-DPSQSSELLAEAKKLNKAQAPK; |
| 1293 | AEAKYAK-[BM]-DPSQSSELLAEAKKLNKAQAPK; and |
| 1294 | ADAKYAK-[BM]-DPSQSSELLSEAKKLNDSQAPK; | wherein [BM] is an IL-17A binding motif as defined in any one of items 1-23.

92. IL-17A binding polypeptide according to any preceding item, which comprises an amino acid sequence selected from:
xiii) VDAKYAK-[BM]-DPSQSSELLSEAKKLNDSQAPK (SEQ ID NO:1281),
wherein [BM] is an IL-17A binding motif as defined in any one of items 1-23; and
xiv) an amino acid sequence which has at least 86% identity to the sequence defined in xiii).

93. IL-17A binding polypeptide according to item 92, wherein sequence xiii) is selected from SEQ ID NO:1-1216.

94. IL-17A binding polypeptide according to item 93, wherein sequence xiii) is selected from SEQ ID NO:1-66, 1200, 1206 and 1214.

95. IL-17A binding polypeptide according to item 94, wherein sequence xiii) is selected from SEQ ID NO:1-66.

96. IL-17A binding polypeptide according to item 95, wherein sequence xiii) is selected from SEQ ID NO:1-35.

97. IL-17A binding polypeptide according to item 96, wherein sequence xiii) is selected from SEQ ID NO:1-27.

98. IL-17A binding polypeptide according to item 97, wherein sequence xiii) is selected from SEQ ID NO:1-10.

99. IL-17A binding polypeptide according to item 98, wherein sequence xiii) is selected from SEQ ID NO:1-7.

100. IL-17A binding polypeptide according to item 99, wherein sequence xiii) is selected from SEQ ID NO:1-4.

101. IL-17A binding polypeptide according to item 100, wherein sequence xiii) is SEQ ID NO:1.

102. IL-17A binding polypeptide according to any one of items 1-91, which comprises an amino acid sequence selected from:
xv) AEAKYAK-[BM]-DPSQSSELLSEAKKLNDSQAPK (SEQ ID NO:1259), wherein [BM] is an IL-17A binding motif as defined in any one of items 1-23; and
xvi) an amino acid sequence which has at least 86% identity to the sequence defined in xv).

103. IL-17A binding polypeptide according to item 102, wherein sequence xv) is selected from SEQ ID NO:1217-1222.

104. IL-17A binding polypeptide according to item 103, wherein sequence xv) is selected from SEQ ID NO:1218-1222.

105. IL-17A binding polypeptide according to item 104, wherein sequence xv) is selected from SEQ ID NO:1219-1222.

106. IL-17A binding polypeptide according to item 105, wherein sequence xv) is selected from SEQ ID NO:1219 and SEQ ID NO:1222.

107. IL-17A binding polypeptide according to item 106, wherein sequence xv) is SEQ ID NO:1219.

108. IL-17A binding polypeptide according to any preceding item, which is capable of binding to IL-17A such that the $K_D$ value of the interaction is at most $1 \times 10^{-6}$ M, such as at most $1 \times 10^{-7}$ M, such as at most $1 \times 10^{-8}$ M, such as at most $1 \times 10^{-6}$ M.

109. IL-17A binding polypeptide according to any preceding item, which is capable of binding to an IL-17A molecule selected from the group consisting of human IL-17A and murine IL-17A.

110. IL-17A binding polypeptide according to item 109, which is capable of binding to human IL-17A.

111. IL-17A binding polypeptide according to item 109, which is capable of binding to murine IL-17A.

112. IL-17A binding polypeptide according to any one of items 109-111, which is capable of binding to human IL-17A and to murine IL-17A. 113. IL-17A binding polypeptide according to any one of items 109, 110 and 112, wherein said human IL-17A comprises the amino acid sequence SEQ ID NO:1226 or an antigenically effective fragment thereof.

114. IL-17A binding polypeptide according to any one of items 109, 111 and 112, wherein said murine IL-17A comprises the amino acid sequence SEQ ID NO:1227 or an antigenically effective fragment thereof.

115. IL-17A binding polypeptide according to any preceding item which comprises additional amino acids at the C-terminal and/or N-terminal end.

116. IL-17A binding polypeptide according to item 115, wherein said additional amino acid(s) improve(s) and/or simplify/simplifies production, purification, stabilization in vivo or in vitro, coupling or detection of the polypeptide.

117. IL-17A binding polypeptide according to any preceding item in multimeric form, comprising at least two IL-17A binding polypeptide monomer units, whose amino acid sequences may be the same or different.

118. IL-17A binding polypeptide according to item 117, wherein said IL-17A binding polypeptide monomer units are covalently coupled together.

119. IL-17A binding polypeptide according to item 118, wherein the IL-17A binding polypeptide monomer units are expressed as a fusion protein.

120. IL-17A binding polypeptide according to any one of items 117-119, in dimeric form.

121. Fusion protein or conjugate comprising
a first moiety consisting of an IL-17A binding polypeptide according to any preceding item; and
a second moiety consisting of a polypeptide having a desired biological activity.

122. Fusion protein or conjugate according to item 121, wherein said desired biological activity is a therapeutic activity.

123. Fusion protein or conjugate according to item 121, wherein said desired biological activity is a binding activity.

124. Fusion protein or conjugate according to item 123, wherein said binding activity is albumin binding activity which increases in vivo half-life of the fusion protein or conjugate.

125. Fusion protein or conjugate according to item 124, comprising two IL-17A binding polypeptides, each as defined in any one of items 1-116, with an albumin binding moiety between them.

126. Fusion protein or conjugate according to item 125, which is capable of binding to IL-17A such that the $K_D$ value of the interaction is at most $1\times10^{-10}$ M, such as at most $1\times10^{-11}$ M, such as at most $1\times10^{-12}$ M, such as at most $1\times10^{-13}$ M.

127. Fusion protein or conjugate according to any one of items 124-126, wherein said second moiety comprises the albumin binding domain of streptococcal protein G or a derivative thereof.

128. Fusion protein or conjugate according to item 123, wherein said binding activity acts to inhibit a biological activity.

129. Fusion protein or conjugate according to item 123, wherein said binding activity acts to stimulate a biological activity.

130. Fusion protein or conjugate according to item 121, wherein said desired biological activity is an enzymatic activity.

131. Fusion protein or conjugate according to item 122, wherein the second moiety is a therapeutically active polypeptide.

132. Fusion protein or conjugate according to item 131, wherein the second moiety is an immune response modifying agent, for example an anti-inflammatory agent.

133. Fusion protein or conjugate according to any one of items 121-122 and 130-132, wherein the second moiety is selected from the group consisting of human endogenous enzymes, hormones, growth factors, chemokines, cytokines and lymphokines, and agonists, antagonists and inhibitors thereof.

134. Fusion protein or conjugate according to item 131, wherein the second moiety is a toxic compound.

135. Fusion protein or conjugate according to item 123, wherein said binding activity is binding to an immune response associated factor, for example an inflammation-associated factor.

136. Complex, comprising at least one IL-17A binding polypeptide according to any one of items 1-117 or at least one fusion protein or conjugate according to any one of items 121-135, and at least one antibody or an antigen binding fragment thereof.

137. Complex according to item 136, wherein said at least one antibody or antigen binding fragment thereof is selected from the group consisting of full-length antibodies, Fab fragments, Fab' fragments, F(ab')2 fragments, Fc fragments, Fv fragments, single chain Fv fragments, (scFv)$_2$ and domain antibodies.

138. Complex according to item 137, wherein said at least one antibody or antigen binding fragment thereof is selected from the group consisting of full-length antibodies, Fab fragments and scFv fragments.

139. Complex according to item 138, wherein said at least one antibody or antigen binding fragment thereof is a full-length antibody.

140. Complex according to any one of items 136-139, wherein said antibody or antigen binding fragment thereof is a monoclonal antibody or an antigen binding fragment thereof.

141. Complex according to any one of items 136-140, wherein said antibody or antigen binding fragment thereof is selected from the group consisting of human antibodies, humanized antibodies and chimeric antibodies, and antigen-binding fragments thereof.

142. Complex according to item 141, wherein said antibody or antigen binding fragment thereof is a human or humanized antibody, or an antigen binding fragment thereof.

143. Complex according to any one of items 136-142, wherein said antibody or antigen binding fragment thereof has affinity for an antigen, such as selected from the group consisting of an antigen associated with an angiogenesis related disorder and an antigen associated with the immune response or with a disorder of the immune system.

144. Complex according to item 143, wherein said antigen is associated with an angiogenesis related disorder.

145. Complex according to item 143, wherein said antigen is associated with the immune response or with a disorder of the immune system, for example associated with inflammation.

146. Complex according to any one of items 136-145, which is a fusion protein or a conjugate.

147. Complex according to any one of items 136-146, wherein said IL-17A binding polypeptide is attached to the N-terminus or C-terminus of the heavy chain of said antibody or antigen binding fragment thereof.

148. Complex according to any one of items 136-146, wherein said IL-17A binding polypeptide is attached to the N-terminus or C-terminus of the light chain of said antibody or antigen binding fragment thereof.

149. Complex according to any one of items 136-146, wherein said IL-17A binding polypeptide is attached to the N-terminus and/or C-terminus of the light chain and heavy chain of said antibody or antigen binding fragment thereof.

150. Complex according to any one of items 146-149, which is a fusion protein.

151. IL-17A binding polypeptide, fusion protein, conjugate or complex according to any preceding item, further comprising at least one linker, for example selected from the group consisting of non-peptidic linkers, flexible amino acid linkers, rigid amino acid linkers and cleavable amino acid linkers.

152. Fusion protein or conjugate according item 151, wherein said linker is arranged between said first moiety and said second moiety.

153. Complex according to item 151, wherein said linker is arranged between said IL-17A binding polypeptide and said antibody or antigen binding fragment thereof.

154. IL-17A binding polypeptide, fusion protein, conjugate or complex according any one of items 151-153, wherein said linker is a flexible linker comprising amino acid residues selected from the group consisting of glycine, serine and threonine.

155. IL-17A binding polypeptide, fusion protein, conjugate or complex according to item 154, wherein said linker comprises a sequence with a general formula selected from $(G_nS_m)_p$ and $(S_nG_m)_p$, wherein, independently, n=1-7,
m=0-7,
n+m≤8 and
p=1-10.

156. IL-17A binding polypeptide, fusion protein, conjugate or complex according to item 155, wherein n=1-5.

157. IL-17A binding polypeptide, fusion protein, conjugate or complex according to any one of items 155-156, wherein m=0-5.

158. IL-17A binding polypeptide, fusion protein, conjugate or complex according to any one of items 155-157, wherein p=1-5.

159. IL-17A binding polypeptide, fusion protein, conjugate or complex according to any one of items 156-158, wherein n=4, m=1 and p=1-4.

160. IL-17A binding polypeptide, fusion protein, conjugate or complex according to item 159, wherein said linker comprises a sequence selected from the group consisting of $G_4S$, $(G_4S)_2$, $(G_4S)_3$ and $(G_4S)_4$.

161. IL-17A binding polypeptide, fusion protein, conjugate or complex according to item 160, wherein said linker comprises the sequence $G_4S$.

162. IL-17A binding polypeptide, fusion protein, conjugate or complex according to any one of items 155-159, wherein said general formula is $GT(G_nS_m)_p$.

163. IL-17A binding polypeptide, fusion protein, conjugate or complex according to item 162, wherein said linker comprises the sequence $GTG_4S$.

164. IL-17A binding polypeptide, fusion protein, conjugate or complex according to any preceding item, further comprising a label.

165. IL-17A binding polypeptide, fusion protein, conjugate or complex according to item 164, wherein said label is selected from the group consisting of fluorescent dyes and metals, chromophoric dyes, chemiluminescent compounds and bioluminescent proteins, enzymes, radionuclides and particles.

166. IL-17A binding polypeptide, fusion protein, conjugate or complex according to any preceding item, comprising a chelating environment provided by a polyaminopolycarboxylate chelator conjugated to the IL-17A binding polypeptide via a thiol group of a cysteine residue or an amine group of a lysine residue.

167. IL-17A binding polypeptide, fusion protein, conjugate or complex according to any preceding item, comprising one or more polyethylene glycol moieties.

168. Polynucleotide encoding a polypeptide according to any one of items 1-163.

169. Expression vector comprising a polynucleotide according to item 168.

170. Host cell comprising an expression vector according to item 169.

171. Method of producing a polypeptide according to any one of items 1-163, comprising culturing a host cell according to item 170 under conditions permissive of expression of said polypeptide from said expression vector, and isolating said polypeptide.

172. Composition comprising an IL-17A binding polypeptide, fusion protein, conjugate or complex according to any one of items 1-167 and at least one pharmaceutically acceptable excipient or carrier.

173. Composition according to item 172, further comprising at least one additional active agent, such as an agent selected from the group consisting of therapeutically active polypeptides, immune response modifying agents, anti-inflammatory agents and toxic compounds.

174. IL-17A binding polypeptide, fusion protein, conjugate or complex according to any one of items 1-167 or a composition according to any one of items 172-173 for oral, topical, intravenous, intraperitoneal, subcutaneous, pulmonary, transdermal, intramuscular, intranasal, buccal, sublingual or suppository administration, such as for oral administration or such as for topical administration.

175. IL-17A binding polypeptide, fusion protein, conjugate or complex according to any one of items 1-167 or a composition according to any one of items 172-173 for use as a medicament, a diagnostic agent or a prognostic agent.

176. IL-17A binding polypeptide, fusion protein, conjugate, complex or composition for use according to item 175, wherein said polypeptide, fusion protein, conjugate, complex or composition modulates IL-17A function in vivo.

177. IL-17A binding polypeptide, fusion protein, conjugate, complex or composition for use according to any one of items 175-176, wherein said polypeptide, fusion protein, conjugate, complex or composition inhibits IL-17A signaling.

178. IL-17A binding polypeptide, fusion protein, conjugate, complex or composition for use according to any one of items 175-177, wherein said polypeptide, fusion protein, conjugate, complex or composition blocks binding of IL-17A to at least one of its cognate receptors.

179. IL-17A binding polypeptide, fusion protein, conjugate, complex or composition for use according to any one of items 175-178, in the treatment, diagnosis or prognosis of an IL-17A associated condition.

180. IL-17A binding polypeptide, fusion protein, conjugate, complex or composition for use according to item 179, wherein said IL-17A associated condition is selected from the group consisting of inflammatory diseases, autoimmune diseases and cancer.

181. IL-17A binding polypeptide, fusion protein, conjugate, complex or composition for use according to item 180, wherein said IL-17A associated condition is selected from the group consisting of inflammatory diseases and autoimmune diseases.

182. IL-17A binding polypeptide, fusion protein, conjugate, complex or composition for use according to item 181, wherein said IL-17A associated condition is selected from the group consisting of inflammatory conditions, allergic conditions, hypersensitivity reactions, autoimmune diseases, severe infections and transplant rejections.

183. IL-17A binding polypeptide, fusion protein, conjugate, complex or composition for use according to item 182, wherein said IL-17A associated condition is selected from the group consisting of rheumatoid arthritis, ankylosing spondylitis, psoriatic arthritis, psoriasis, multiple sclerosis, systemic lupus erythematosus, uveitis and dry eye disease.

184. IL-17A binding polypeptide, fusion protein, conjugate, complex or composition for use according to item 183, wherein said IL-17A associated condition is psoriasis.

185. IL-17A binding polypeptide, fusion protein, conjugate or complex for use in prognosis according to item 179, wherein said IL-17A associated condition is cancer, such as a cancer selected from the group consisting of gastric cancers, colorectal cancers, non-small cell lung cancers, hepatocellular carcinomas and adenocarcinomas.

186. Method of detecting IL-17A, comprising providing a sample suspected to contain IL-17A, contacting said sample with an IL-17A binding polypeptide, fusion protein, conjugate or complex according to any one of items 1-167 or a composition according to any one of items 172-173, and detecting the binding of the IL-17A binding polypeptide, fusion protein, conjugate, complex or composition to indicate the presence of IL-17A in the sample.

187. Method for determining the presence of IL-17A in a subject, the method comprising the steps:
contacting the subject, or a sample isolated from the subject, with an IL-17A binding polypeptide, fusion protein, conjugate or complex according to any one of items 1-167 or a composition according to any one of items 172-173, and
obtaining a value corresponding to the amount of the IL-17A binding polypeptide, fusion protein, conjugate, complex or composition that has bound in said subject or to said sample.

188. Method according to item 187, further comprising a step of comparing said value to a reference.

189. Method according to item 187 or 188, wherein said subject is a mammalian subject, such as a human subject.

190. Method according to any one of items 187-189, performed in vivo.

191. Method according to any one of items 187-189, performed in vitro.

192. Method of treatment of an IL-17A associated condition, comprising administering to a subject in need thereof an effective amount of an IL-17A binding polypeptide, fusion protein, conjugate or complex according to any one of items 1-167 or a composition according to any one of items 172-173.

193. Method according to item 192, wherein said IL-17A associated condition is selected from the group consisting of inflammatory diseases, autoimmune diseases and cancer.

194. Method according to item 193, wherein said IL-17A associated condition is selected from the group consisting of inflammatory diseases and autoimmune diseases.

195. Method according to item 194, wherein said IL-17A associated condition is selected from the group consisting of inflammatory conditions, allergic conditions, hypersensitivity reactions, autoimmune diseases, severe infections and transplant rejections.

196. Method according to item 195, wherein said IL-17A associated condition is selected from the group consisting of rheumatoid arthritis, ankylosing spondylitis, psoriatic arthritis, psoriasis, multiple sclerosis, systemic lupus erythematosus, uveitis and dry eye disease.

197. Method according to item 196, wherein said IL-17A associated condition is psoriasis.

SEQUENCE LISTING (1317 sequences)

SEQ ID NO: 1 - protein, 58 aa, ARTIFICIAL SEQUENCE
  Engineered IL-17A binding polypeptide
VDAKYAKEADDAAVEIASLPNLTWDQWYAFIQKLRDDPSQSSELLSEAKKLNDSQAPK

SEQ ID NO: 2 - protein, 58 aa, ARTIFICIAL SEQUENCE
  Engineered IL-17A binding polypeptide
VDAKYAKEADDAAVEIAALPNLTWDQWFAFISKLRDDPSQSSELLSEAKKLNDSQAPK

SEQ ID NO: 3 - protein, 58 aa, ARTIFICIAL SEQUENCE
  Engineered IL-17A binding polypeptide
VDAKYAKEADQAAVEIADLPNLTWAQWYAFIQKLRDDPSQSSELLSEAKKLNDSQAPK

SEQ ID NO: 4 - protein, 58 aa, ARTIFICIAL SEQUENCE
  Engineered IL-17A binding polypeptide
VDAKYAKEADDAAVEIASLPNLTWAQWYAFIQKLRDDPSQSSELLSEAKKLNDSQAPK

SEQ ID NO: 5 - protein, 58 aa, ARTIFICIAL SEQUENCE
  Engineered IL-17A binding polypeptide
VDAKYAKEADAAAVEIAELPNLTWDQWWAFINKLRDDPSQSSELLSEAKKLNDSQAPK

SEQ ID NO: 6 - protein, 58 aa, ARTIFICIAL SEQUENCE
  Engineered IL-17A binding polypeptide
VDAKYAKEADDAALEIADLPNLTWDQWWAFISKLRDDPSQSSELLSEAKKLNDSQAPK

SEQ ID NO: 7 - protein, 58 aa, ARTIFICIAL SEQUENCE
  Engineered IL-17A binding polypeptide
VDAKYAKEADRAAVEIADLPNLTWDQWYAFIEKLRDDPSQSSELLSEAKKLNDSQAPK

SEQ ID NO: 8 - protein, 58 aa, ARTIFICIAL SEQUENCE
  Engineered IL-17A binding polypeptide
VDAKYAKEADDAAYEIAYLPNLTWDQWFAFITKLRDDPSQSSELLSEAKKLNDSQAPK

SEQ ID NO: 9 - protein, 58 aa, ARTIFICIAL SEQUENCE
  Engineered IL-17A binding polypeptide
VDAKYAKEADQAAYEIAFLPNLTWDQWFAFINKLRDDPSQSSELLSEAKKLNDSQAPK

SEQ ID NO: 10 - protein, 58 aa, ARTIFICIAL SEQUENCE
  Engineered IL-17A binding polypeptide
VDAKYAKEADDAAYEIAFLPNLTWDQWWAFIQKLRDDPSQSSELLSEAKKLNDSQAPK

SEQ ID NO: 11 - protein, 58 aa, ARTIFICIAL SEQUENCE
  Engineered IL-17A binding polypeptide
VDAKYAKEADDAAVEIADLPNLTWDQWYAFISKLRDDPSQSSELLSEAKKLNDSQAPK

SEQ ID NO: 12 - protein, 58 aa, ARTIFICIAL SEQUENCE
  Engineered IL-17A binding polypeptide
VDAKYAKEADEAAVEIADLPNLTWDQWYAFIQKLRDDPSQSSELLSEAKKLNDSQAPK

SEQ ID NO: 13 - protein, 58 aa, ARTIFICIAL SEQUENCE
  Engineered IL-17A binding polypeptide
VDAKYAKEADDAAVEIADLPNLTWAQWYAFIGKLRDDPSQSSELLSEAKKLNDSQAPK

SEQ ID NO: 14 - protein, 58 aa, ARTIFICIAL SEQUENCE
  Engineered IL-17A binding polypeptide
VDAKYAKEADDAAIEIASLPNLTWDQWYAFIGKLRDDPSQSSELLSEAKKLNDSQAPK

SEQ ID NO: 15 - protein, 58 aa, ARTIFICIAL SEQUENCE
  Engineered IL-17A binding polypeptide
VDAKYAKEADDAAVEIADLPNLTWDQWFAFIQKLRDDPSQSSELLSEAKKLNDSQAPK

SEQ ID NO: 16 - protein, 58 aa, ARTIFICIAL SEQUENCE
  Engineered IL-17A binding polypeptide
VDAKYAKEADDAAVEIADLPNLTWDQWHAFIQKLRDDPSQSSELLSEAKKLNDSQAPK

SEQ ID NO: 17 - protein, 58 aa, ARTIFICIAL SEQUENCE
  Engineered IL-17A binding polypeptide
VDAKYAKEADDAAYEIAFLPNLTWDQWFAFISKLRDDPSQSSELLSEAKKLNDSQAPK

SEQ ID NO: 18 - protein, 58 aa, ARTIFICIAL SEQUENCE
  Engineered IL-17A binding polypeptide
VDAKYAKEADDAAVEIADLPNLTWDQWYAFITKLRDDPSQSSELLSEAKKLNDSQAPK

SEQ ID NO: 19 - protein, 58 aa, ARTIFICIAL SEQUENCE
  Engineered IL-17A binding polypeptide
VDAKYAKEADLAAVEIADLPNLTWDQWWAFIQKLRDDPSQSSELLSEAKKLNDSQAPK

SEQ ID NO: 20 - protein, 58 aa, ARTIFICIAL SEQUENCE
  Engineered IL-17A binding polypeptide
VDAKYAKEADDAAYEIAYLPNLTWDQWYAFIQKLRDDPSQSSELLSEAKKLNDSQAPK

SEQ ID NO: 21 - protein, 58 aa, ARTIFICIAL SEQUENCE
  Engineered IL-17A binding polypeptide
VDAKYAKEADDAAVEIAALPNLTWDQWWAFIGKLRDDPSQSSELLSEAKKLNDSQAPK

SEQ ID NO: 22 - protein, 58 aa, ARTIFICIAL SEQUENCE
  Engineered IL-17A binding polypeptide
VDAKYAKEADEAAVEIADLPNLTWDQWWAFINKLRDDPSQSSELLSEAKKLNDSQAPK

SEQ ID NO: 23 - protein, 58 aa, ARTIFICIAL SEQUENCE
  Engineered IL-17A binding polypeptide
VDAKYAKEADDAAVEIADLPNLTWDQWYAFIAKLRDDPSQSSELLSEAKKLNDSQAPK

SEQ ID NO: 24 - protein, 58 aa, ARTIFICIAL SEQUENCE
  Engineered IL-17A binding polypeptide
VDAKYAKEADDAAVEIADLPNLTWDQWFAFINKLRDDPSQSSELLSEAKKLNDSQAPK

SEQ ID NO: 25 - protein, 58 aa, ARTIFICIAL SEQUENCE
  Engineered IL-17A binding polypeptide
VDAKYAKEADDAAYEIAFLPNLTWEQWFAFIDKLRDDPSQSSELLSEAKKLNDSQAPK

SEQ ID NO: 26 - protein, 58 aa, ARTIFICIAL SEQUENCE
  Engineered IL-17A binding polypeptide
VDAKYAKEADDAAVEIAYLPNLTWDQWWAFIRKLRDDPSQSSELLSEAKKLNDSQAPK

SEQ ID NO: 27 - protein, 58 aa, ARTIFICIAL SEQUENCE
  Engineered IL-17A binding polypeptide
VDAKYAKEADDAAVEIADLPNLTWDQWWAFILKLRDDPSQSSELLSEAKKLNDSQAPK

SEQ ID NO: 28 - protein, 58 aa, ARTIFICIAL SEQUENCE
  Engineered IL-17A binding polypeptide
VDAKYAKEADDAAFEIAALPNLTWDQWYAFIIKLRDDPSQSSELLSEAKKLNDSQAPK

SEQ ID NO: 29 - protein, 58 aa, ARTIFICIAL SEQUENCE
  Engineered IL-17A binding polypeptide
VDAKYAKEADEAAVEIAELPNLTWDQWYAFIRKLRDDPSQSSELLSEAKKLNDSQAPK

SEQ ID NO: 30 - protein, 58 aa, ARTIFICIAL SEQUENCE
  Engineered IL-17A binding polypeptide
VDAKYAKEADDAALEIAELPNLTWVQWYAFIQKLRDDPSQSSELLSEAKKLNDSQAPK

SEQ ID NO: 31 - protein, 58 aa, ARTIFICIAL SEQUENCE
  Engineered IL-17A binding polypeptide
VDAKYAKEADFAAVEIAELPNLTWDQWYAFIQKLRDDPSQSSELLSEAKKLNDSQAPK

SEQ ID NO: 32 - protein, 58 aa, ARTIFICIAL SEQUENCE
  Engineered IL-17A binding polypeptide
VDAKYAKEADDAAVEIADLPNLTWAQWEAFISKLRDDPSQSSELLSEAKKLNDSQAPK

SEQ ID NO: 33 - protein, 58 aa, ARTIFICIAL SEQUENCE
  Engineered IL-17A binding polypeptide
VDAKYAKEADDAAYEIAGLPNLTWDQWYAFIEKLRDDPSQSSELLSEAKKLNDSQAPK

SEQ ID NO: 34 - protein, 58 aa, ARTIFICIAL SEQUENCE
  Engineered IL-17A binding polypeptide
VDAKYAKEADDAAYEIASLPNLTWDQWWAFIGKLRDDPSQSSELLSEAKKLNDSQAPK

SEQ ID NO: 35 - protein, 58 aa, ARTIFICIAL SEQUENCE
  Engineered IL-17A binding polypeptide
VDAKYAKEADRAAVEIADLPNLTWDQWWAFIEKLRDDPSQSSELLSEAKKLNDSQAPK

SEQ ID NO: 36 - protein, 58 aa, ARTIFICIAL SEQUENCE
  Engineered IL-17A binding polypeptide
VDAKYAKEMDYAQWEIWLLPNLTWDQGHAFISKLIDDPSQSSELLSEAKKLNDSQAPK

SEQ ID NO: 37 - protein, 58 aa, ARTIFICIAL SEQUENCE
  Engineered IL-17A binding polypeptide
VDAKYAKEADDAAVEIADLPNLTWDQWFAFIHKLRDDPSQSSELLSEAKKLNDSQAPK

SEQ ID NO: 38 - protein, 58 aa, ARTIFICIAL SEQUENCE
  Engineered IL-17A binding polypeptide
VDAKYAKEADDAAFEIAMLPNLTWDQWYAFIRKLRDDPSQSSELLSEAKKLNDSQAPK

SEQ ID NO: 39 - protein, 58 aa, ARTIFICIAL SEQUENCE
  Engineered IL-17A binding polypeptide
VDAKYAKEADNAAVEIADLPNLTWVQWYAFIQKLRDDPSQSSELLSEAKKLNDSQAPK

SEQ ID NO: 40 - protein, 58 aa, ARTIFICIAL SEQUENCE
  Engineered IL-17A binding polypeptide
VDAKYAKEADDAAVEIAELPNLTWDQWFAFIQKLRDDPSQSSELLSEAKKLNDSQAPK

SEQ ID NO: 41 - protein, 58 aa, ARTIFICIAL SEQUENCE
  Engineered IL-17A binding polypeptide
VDAKYAKEADDAAVEIASLPNLTWDQWYAFISKLRDDPSQSSELLSEAKKLNDSQAPK

SEQ ID NO: 42 - protein, 58 aa, ARTIFICIAL SEQUENCE
  Engineered IL-17A binding polypeptide
VDAKYAKEADQAAVEIADLPNLTWDQWYAFIQKLRDDPSQSSELLSEAKKLNDSQAPK

SEQ ID NO: 43 - protein, 58 aa, ARTIFICIAL SEQUENCE
  Engineered IL-17A binding polypeptide
VDAKYAKEADDAAVEIAMLPNLTWDQWYAFIQKLRDDPSQSSELLSEAKKLNDSQAPK

SEQ ID NO: 44 - protein, 58 aa, ARTIFICIAL SEQUENCE
  Engineered IL-17A binding polypeptide
VDAKYAKEADNAAVEIADLPNLTWDQWFAFIHKLRDDPSQSSELLSEAKKLNDSQAPK

SEQ ID NO: 45 - protein, 58 aa, ARTIFICIAL SEQUENCE
  Engineered IL-17A binding polypeptide
VDAKYAKEADEAAVEIADLPNLTWDQWYAFIAKLRDDPSQSSELLSEAKKLNDSQAPK

SEQ ID NO: 46 - protein, 58 aa, ARTIFICIAL SEQUENCE
  Engineered IL-17A binding polypeptide
VDAKYAKEADDAAVEIADLPNLTWDQWYAFIQKLRDDPSQSSELLSEAKKLNDSQAPK

SEQ ID NO: 47 - protein, 58 aa, ARTIFICIAL SEQUENCE
  Engineered IL-17A binding polypeptide
VDAKYAKEADDAAVEIAMLPNLTWDQWYAFIGKLRDDPSQSSELLSEAKKLNDSQAPK

SEQ ID NO: 48 - protein, 58 aa, ARTIFICIAL SEQUENCE
  Engineered IL-17A binding polypeptide
VDAKYAKEADRAAMEIAELPNLTWDQWYAFISKLRDDPSQSSELLSEAKKLNDSQAPK

SEQ ID NO: 49 - protein, 58 aa, ARTIFICIAL SEQUENCE
  Engineered IL-17A binding polypeptide
VDAKYAKEADDAAVEIAELPNLTWDQWYAFIGKLRDDPSQSSELLSEAKKLNDSQAPK

SEQ ID NO: 50 - protein, 58 aa, ARTIFICIAL SEQUENCE
  Engineered IL-17A binding polypeptide
VDAKYAKEADNAAVEIAMLPNLTWDQWYAFIGKLRDDPSQSSELLSEAKKLNDSQAPK

SEQ ID NO: 51 - protein, 58 aa, ARTIFICIAL SEQUENCE
  Engineered IL-17A binding polypeptide
VDAKYAKEADDAAVEIAALPNLTWDQWYAFIGKLRDDPSQSSELLSEAKKLNDSQAPK

SEQ ID NO: 52 - protein, 58 aa, ARTIFICIAL SEQUENCE
  Engineered IL-17A binding polypeptide
VDAKYAKEADNAAVEIASLPNLTWDQWFAFIGKLRDDPSQSSELLSEAKKLNDSQAPK

SEQ ID NO: 53 - protein, 58 aa, ARTIFICIAL SEQUENCE
  Engineered IL-17A binding polypeptide
VDAKYAKEADDAAVEIALLPNLTWDQWYAFIGKLRDDPSQSSELLSEAKKLNDSQAPK

SEQ ID NO: 54 - protein, 58 aa, ARTIFICIAL SEQUENCE
  Engineered IL-17A binding polypeptide
VDAKYAKEADDAAVEIASLPNLTWDQWFAFISKLRDDPSQSSELLSEAKKLNDSQAPK

SEQ ID NO: 55 - protein, 58 aa, ARTIFICIAL SEQUENCE
  Engineered IL-17A binding polypeptide
VDAKYAKEADDAAVEIADLPNLTWDQWFAFIGKLRDDPSQSSELLSEAKKLNDSQAPK

SEQ ID NO: 56 - protein, 58 aa, ARTIFICIAL SEQUENCE
  Engineered IL-17A binding polypeptide
VDAKYAKEADDAAVEIADLPNLTWAQWFAFIQKLRDDPSQSSELLSEAKKLNDSQAPK

SEQ ID NO: 57 - protein, 58 aa, ARTIFICIAL SEQUENCE
  Engineered IL-17A binding polypeptide
VDAKYAKEADDAAVEIAALPNLTWDQWFAFIQKLRDDPSQSSELLSEAKKLNDSQAPK

SEQ ID NO: 58 - protein, 58 aa, ARTIFICIAL SEQUENCE
  Engineered IL-17A binding polypeptide
VDAKYAKEADNAAVEIADLPNLTWDQWYAFIAKLRDDPSQSSELLSEAKKLNDSQAPK

SEQ ID NO: 59 - protein, 58 aa, ARTIFICIAL SEQUENCE
  Engineered IL-17A binding polypeptide
VDAKYAKEADEAAVEIAELPNLTWDQWYAFIGKLRDDPSQSSELLSEAKKLNDSQAPK

SEQ ID NO: 60 - protein, 58 aa, ARTIFICIAL SEQUENCE
  Engineered IL-17A binding polypeptide
VDAKYAKEADNAAMEIADLPNLTWDQWFAFIQKLRDDPSQSSELLSEAKKLNDSQAPK

SEQ ID NO: 61 - protein, 58 aa, ARTIFICIAL SEQUENCE
  Engineered IL-17A binding polypeptide
VDAKYAKEADDAAVEIAALPNLTWDQWYAFIQKLRDDPSQSSELLSEAKKLNDSQAPK

SEQ ID NO: 62 - protein, 58 aa, ARTIFICIAL SEQUENCE
  Engineered IL-17A binding polypeptide
VDAKYAKEADDAAVEIAELPNLTWAQWFAFIGKLRDDPSQSSELLSEAKKLNDSQAPK

SEQ ID NO: 63 - protein, 58 aa, ARTIFICIAL SEQUENCE
  Engineered IL-17A binding polypeptide
VDAKYAKEADEAAVEIADLPNLTWDQWFAFIQKLRDDPSQSSELLSEAKKLNDSQAPK

SEQ ID NO: 64 - protein, 58 aa, ARTIFICIAL SEQUENCE
  Engineered IL-17A binding polypeptide
VDAKYAKEADDAAVEIALLPNLTWDQWYAFINKLRDDPSQSSELLSEAKKLNDSQAPK

SEQ ID NO: 65 - protein, 58 aa, ARTIFICIAL SEQUENCE
  Engineered IL-17A binding polypeptide
VDAKYAKEADNAALEIANLPNLTWDQWWAFITKLRDDPSQSSELLSEAKKLNDSQAPK

SEQ ID NO: 66 - protein, 58 aa, ARTIFICIAL SEQUENCE
  Engineered IL-17A binding polypeptide
VDAKYAKEADMAAVEIAELPNLTWEQWWAFIGKLRDDPSQSSELLSEAKKLNDSQAPK

SEQ ID NO: 67 - protein, 58 aa, ARTIFICIAL SEQUENCE
  Engineered IL-17A binding polypeptide
VDAKYAKEADEAAVEIAMLPNLTWDQWHAFIHKLRDDPSQSSELLSEAKKLNDSQAPK

SEQ ID NO: 68 - protein, 58 aa, ARTIFICIAL SEQUENCE
  Engineered IL-17A binding polypeptide
VDAKYAKEADNAAWEIASLPNLTWDQWFAFIGKLRDDPSQSSELLSEAKKLNDSQAPK

SEQ ID NO: 69 - protein, 58 aa, ARTIFICIAL SEQUENCE
  Engineered IL-17A binding polypeptide
VDAKYAKEADRAAVEIAELPNLTWDQWHAFIGKLRDDPSQSSELLSEAKKLNDSQAPK

SEQ ID NO: 70 - protein, 58 aa, ARTIFICIAL SEQUENCE
  Engineered IL-17A binding polypeptide
VDAKYAKEADDAAMEIADLPNLTWAQWNAFISKLRDDPSQSSELLSEAKKLNDSQAPK

SEQ ID NO: 71 - protein, 58 aa, ARTIFICIAL SEQUENCE
  Engineered IL-17A binding polypeptide
VDAKYAKEADNAAVEIAALPNLTWDQWSAFIQKLRDDPSQSSELLSEAKKLNDSQAPK

SEQ ID NO: 72 - protein, 58 aa, ARTIFICIAL SEQUENCE
  Engineered IL-17A binding polypeptide
VDAKYAKEADEAAVEIAELPNLTWDQWFAFIGKLRDDPSQSSELLSEAKKLNDSQAPK

SEQ ID NO: 73 - protein, 58 aa, ARTIFICIAL SEQUENCE
  Engineered IL-17A binding polypeptide
VDAKYAKEADDAAVEIALLPNLTWAQWFAFIQKLRDDPSQSSELLSEAKKLNDSQAPK

SEQ ID NO: 74 - protein, 58 aa, ARTIFICIAL SEQUENCE
  Engineered IL-17A binding polypeptide
VDAKYAKEADDAAVEIADLPNLTWDQWNAFIRKLRDDPSQSSELLSEAKKLNDSQAPK

SEQ ID NO: 75 - protein, 58 aa, ARTIFICIAL SEQUENCE
  Engineered IL-17A binding polypeptide
VDAKYAKEADNAAIEIALLPNLTWVQWHAFIQKLRDDPSQSSELLSEAKKLNDSQAPK

SEQ ID NO: 76 - protein, 58 aa, ARTIFICIAL SEQUENCE
  Engineered IL-17A binding polypeptide
VDAKYAKEADNAAMEIADLPNLTWAQWHAFIQKLRDDPSQSSELLSEAKKLNDSQAPK

SEQ ID NO: 77 - protein, 58 aa, ARTIFICIAL SEQUENCE
  Engineered IL-17A binding polypeptide
VDAKYAKEADNAAVEIAALPNLTWDQWFAFIHKLRDDPSQSSELLSEAKKLNDSQAPK

SEQ ID NO: 78 - protein, 58 aa, ARTIFICIAL SEQUENCE
  Engineered IL-17A binding polypeptide
VDAKYAKEADDAALEIADLPNLTWDQWFAFISKLRDDPSQSSELLSEAKKLNDSQAPK

SEQ ID NO: 79 - protein, 58 aa, ARTIFICIAL SEQUENCE
  Engineered IL-17A binding polypeptide
VDAKYAKEADQAAVEIADLPNLTWDQWYAFIVKLRDDPSQSSELLSEAKKLNDSQAPK

SEQ ID NO: 80 - protein, 58 aa, ARTIFICIAL SEQUENCE
  Engineered IL-17A binding polypeptide
VDAKYAKEADDAAVEIATLPNLTWDQWSAFIRKLRDDPSQSSELLSEAKKLNDSQAPK

SEQ ID NO: 81 - protein, 58 aa, ARTIFICIAL SEQUENCE
  Engineered IL-17A binding polypeptide
VDAKYAKEADEAAFEIAALPNLTWDQWFAFIRKLRDDPSQSSELLSEAKKLNDSQAPK

SEQ ID NO: 82 - protein, 58 aa, ARTIFICIAL SEQUENCE
  Engineered IL-17A binding polypeptide
VDAKYAKEADDAAVEIAALPNLTWDQWFAFIRKLRDDPSQSSELLSEAKKLNDSQAPK

SEQ ID NO: 83 - protein, 58 aa, ARTIFICIAL SEQUENCE
  Engineered IL-17A binding polypeptide
VDAKYAKEADDAAVEIADLPNLTYDQWFAFIGKLRDDPSQSSELLSEAKKLNDSQAPK

SEQ ID NO: 84 - protein, 58 aa, ARTIFICIAL SEQUENCE
  Engineered IL-17A binding polypeptide
VDAKYAKEADDAAVEIADLPNLTWDQWHAFIIKLRDDPSQSSELLSEAKKLNDSQAPK

SEQ ID NO: 85 - protein, 58 aa, ARTIFICIAL SEQUENCE
  Engineered IL-17A binding polypeptide
VDAKYAKEADDAAFEIAALPNLTWAQWFAFIGKLRDDPSQSSELLSEAKKLNDSQAPK

SEQ ID NO: 86 - protein, 58 aa, ARTIFICIAL SEQUENCE
  Engineered IL-17A binding polypeptide
VDAKYAKEADEAAFEIADLPNLTWVQWFAFIQKLRDDPSQSSELLSEAKKLNDSQAPK

SEQ ID NO: 87 - protein, 58 aa, ARTIFICIAL SEQUENCE
  Engineered IL-17A binding polypeptide
VDAKYAKEADQAAVEIADLPNLTWDQWFAFIGKLRDDPSQSSELLSEAKKLNDSQAPK

SEQ ID NO: 88 - protein, 58 aa, ARTIFICIAL SEQUENCE
  Engineered IL-17A binding polypeptide
VDAKYAKEADDAAMEIAELPNLTWAQWSAFIAKLRDDPSQSSELLSEAKKLNDSQAPK

SEQ ID NO: 89 - protein, 58 aa, ARTIFICIAL SEQUENCE
  Engineered IL-17A binding polypeptide
VDAKYAKEADDAAIEIAELPNLTWDQWYAFIGKLRDDPSQSSELLSEAKKLNDSQAPK

SEQ ID NO: 90 - protein, 58 aa, ARTIFICIAL SEQUENCE
  Engineered IL-17A binding polypeptide
VDAKYAKEADDAAFEIALLPNLTWDQWSAFIQKLRDDPSQSSELLSEAKKLNDSQAPK

SEQ ID NO: 91 - protein, 58 aa, ARTIFICIAL SEQUENCE
  Engineered IL-17A binding polypeptide
VDAKYAKEADEAAMEIAELPNLTWDQWFAFISKLRDDPSQSSELLSEAKKLNDSQAPK

SEQ ID NO: 92 - protein, 58 aa, ARTIFICIAL SEQUENCE
  Engineered IL-17A binding polypeptide
VDAKYAKEADDAAFEIAALPNLTWDQWFAFISKLRDDPSQSSELLSEAKKLNDSQAPK

SEQ ID NO: 93 - protein, 58 aa, ARTIFICIAL SEQUENCE
  Engineered IL-17A binding polypeptide
VDAKYAKEADEAAVEIASLPNLTWDQWHAFIIKLRDDPSQSSELLSEAKKLNDSQAPK

SEQ ID NO: 94 - protein, 58 aa, ARTIFICIAL SEQUENCE
  Engineered IL-17A binding polypeptide
VDAKYAKEADRAAVEIASLPNLTWAQWHAFIQKLRDDPSQSSELLSEAKKLNDSQAPK

SEQ ID NO: 95 - protein, 58 aa, ARTIFICIAL SEQUENCE
  Engineered IL-17A binding polypeptide
VDAKYAKEADNAAVEIAALPNLTWDQWHAFIQKLRDDPSQSSELLSEAKKLNDSQAPK

SEQ ID NO: 96 - protein, 58 aa, ARTIFICIAL SEQUENCE
  Engineered IL-17A binding polypeptide
VDAKYAKEADEAAMEIADLPNLTWVQWSAFISKLRDDPSQSSELLSEAKKLNDSQAPK

SEQ ID NO: 97 - protein, 58 aa, ARTIFICIAL SEQUENCE
  Engineered IL-17A binding polypeptide
VDAKYAKEADEAAVEIATLPNLTWDQWFAFIQKLRDDPSQSSELLSEAKKLNDSQAPK

SEQ ID NO: 98 - protein, 58 aa, ARTIFICIAL SEQUENCE
  Engineered IL-17A binding polypeptide
VDAKYAKEADDAAVEIALLPNLTWDQWHAFIGKLRDDPSQSSELLSEAKKLNDSQAPK

SEQ ID NO: 99 - protein, 58 aa, ARTIFICIAL SEQUENCE
  Engineered IL-17A binding polypeptide
VDAKYAKEADEAAVEIASLPNLTWDQWYAFIRKLRDDPSQSSELLSEAKKLNDSQAPK

SEQ ID NO: 100 - protein, 58 aa, ARTIFICIAL SEQUENCE
  Engineered IL-17A binding polypeptide
VDAKYAKEADDAALEIAELPNLTWDQWYAFIVKLRDDPSQSSELLSEAKKLNDSQAPK

SEQ ID NO: 101 - protein, 58 aa, ARTIFICIAL SEQUENCE
  Engineered IL-17A binding polypeptide
VDAKYAKEADDAAFEIAALPNLTWDQWFAFIQKLRDDPSQSSELLSEAKKLNDSQAPK

SEQ ID NO: 102 - protein, 58 aa, ARTIFICIAL SEQUENCE
  Engineered IL-17A binding polypeptide
VDAKYAKEADDAAVEIADLPNLTWRQWYAFIQKLRDDPSQSSELLSEAKKLNDSQAPK

SEQ ID NO: 103 - protein, 58 aa, ARTIFICIAL SEQUENCE
  Engineered IL-17A binding polypeptide
VDAKYAKEADDAAVEIAELPNLTWDQWFAFIRKLRDDPSQSSELLSEAKKLNDSQAPK

SEQ ID NO: 104 - protein, 58 aa, ARTIFICIAL SEQUENCE
  Engineered IL-17A binding polypeptide
VDAKYAKEADDAAVEIADLPNLTWAQWYAFIVKLRDDPSQSSELLSEAKKLNDSQAPK

SEQ ID NO: 105 - protein, 58 aa, ARTIFICIAL SEQUENCE
  Engineered IL-17A binding polypeptide
VDAKYAKEADDAAMEIADLPNLTWDQWFAFISKLRDDPSQSSELLSEAKKLNDSQAPK

SEQ ID NO: 106 - protein, 58 aa, ARTIFICIAL SEQUENCE
  Engineered IL-17A binding polypeptide
VDAKYAKEADDAAVEIADLPNLTWRQWFAFIQKLRDDPSQSSELLSEAKKLNDSQAPK

SEQ ID NO: 107 - protein, 58 aa, ARTIFICIAL SEQUENCE
  Engineered IL-17A binding polypeptide
VDAKYAKEADDAAVEIAALPNLTWHQWNAFIQKLRDDPSQSSELLSEAKKLNDSQAPK

SEQ ID NO: 108 - protein, 58 aa, ARTIFICIAL SEQUENCE
  Engineered IL-17A binding polypeptide
VDAKYAKEADQAAVEIAALPNLTWRQWYAFIGKLRDDPSQSSELLSEAKKLNDSQAPK

SEQ ID NO: 109 - protein, 58 aa, ARTIFICIAL SEQUENCE
  Engineered IL-17A binding polypeptide
VDAKYAKEADDAAVEIADLPNLTWAQWHAFIQKLRDDPSQSSELLSEAKKLNDSQAPK

SEQ ID NO: 110 - protein, 58 aa, ARTIFICIAL SEQUENCE
  Engineered IL-17A binding polypeptide
VDAKYAKEADEAAVEIAALPNLTWHQWHAFISKLRDDPSQSSELLSEAKKLNDSQAPK

SEQ ID NO: 111 - protein, 58 aa, ARTIFICIAL SEQUENCE
  Engineered IL-17A binding polypeptide
VDAKYAKEADQAAVEIADLPNLTTAQWYAFIQKLRDDPSQSSELLSEAKKLNDSQAPK

SEQ ID NO: 112 - protein, 58 aa, ARTIFICIAL SEQUENCE
  Engineered IL-17A binding polypeptide
VDAKYAKEADQAAVEIADLPNLTWDQWHAFIIKLRDDPSQSSELLSEAKKLNDSQAPK

SEQ ID NO: 113 - protein, 58 aa, ARTIFICIAL SEQUENCE
  Engineered IL-17A binding polypeptide
VDAKYAKEADYAAFEIASLPNLTWDQWFAFIGKLRDDPSQSSELLSEAKKLNDSQAPK

SEQ ID NO: 114 - protein, 58 aa, ARTIFICIAL SEQUENCE
  Engineered IL-17A binding polypeptide
VDAKYAKEADDAAFEIAELPNLTWDQWHAFISKLRDDPSQSSELLSEAKKLNDSQAPK

SEQ ID NO: 115 - protein, 58 aa, ARTIFICIAL SEQUENCE
  Engineered IL-17A binding polypeptide
VDAKYAKEYDEAWFEIWALPNLTWDQAVAFIRKLNDDPSQSSELLSEAKKLNDSQAPK

SEQ ID NO: 116 - protein, 58 aa, ARTIFICIAL SEQUENCE
  Engineered IL-17A binding polypeptide
VDAKYAKEADEAWFEIWTLPNLTHAQQVAFIRKLIDDPSQSSELLSEAKKLNDSQAPK

SEQ ID NO: 117 - protein, 58 aa, ARTIFICIAL SEQUENCE
  Engineered IL-17A binding polypeptide
VDAKYAKEMDDAWWEIWSLPNLTYDQQYAFIVKLLDDPSQSSELLSEAKKLNDSQAPK

SEQ ID NO: 118 - protein, 58 aa, ARTIFICIAL SEQUENCE
  Engineered IL-17A binding polypeptide
VDAKYAKEHDNAWFEIWSLPNLTWDQARAFIVKLNDDPSQSSELLSEAKKLNDSQAPK

SEQ ID NO: 119 - protein, 58 aa, ARTIFICIAL SEQUENCE
  Engineered IL-17A binding polypeptide
VDAKYAKEADYAWFEIWMLPNLTYDQQKAFIVKLNDDPSQSSELLSEAKKLNDSQAPK

SEQ ID NO: 120 - protein, 58 aa, ARTIFICIAL SEQUENCE
  Engineered IL-17A binding polypeptide
VDAKYAKEWDDAQWEIWLLPNLTWDQQHAFIQKLIDDPSQSSELLSEAKKLNDSQAPK

SEQ ID NO: 121 - protein, 58 aa, ARTIFICIAL SEQUENCE
  Engineered IL-17A binding polypeptide
VDAKYAKEMADAQWEIWMLPNLTWAQGNAFISKLIDDPSQSSELLSEAKKLNDSQAPK

SEQ ID NO: 122 - protein, 58 aa, ARTIFICIAL SEQUENCE
  Engineered IL-17A binding polypeptide
VDAKYAKEMDDAQWEIWMLPNLTWHQSHAFIRKLLDDPSQSSELLSEAKKLNDSQAPK

SEQ ID NO: 123 - protein, 58 aa, ARTIFICIAL SEQUENCE
  Engineered IL-17A binding polypeptide
VDAKYAKEMAYAQWEIWLLPNLTYDQGHAFIVKLLDDPSQSSELLSEAKKLNDSQAPK

SEQ ID NO: 124 - protein, 58 aa, ARTIFICIAL SEQUENCE
  Engineered IL-17A binding polypeptide
VDAKYAKEMDEAWFEIWMLPNLTYVQQVAFIQKLIDDPSQSSELLSEAKKLNDSQAPK

SEQ ID NO: 125 - protein, 58 aa, ARTIFICIAL SEQUENCE
  Engineered IL-17A binding polypeptide
VDAKYAKEHDYAWFEIWALPNLTWDQQVAFIHKLNDDPSQSSELLSEAKKLNDSQAPK

SEQ ID NO: 126 - protein, 58 aa, ARTIFICIAL SEQUENCE
  Engineered IL-17A binding polypeptide
VDAKYAKEMDEAQWEIWLLPNLTWDQSNAFIRKLIDDPSQSSELLSEAKKLNDSQAPK

SEQ ID NO: 127 - protein, 58 aa, ARTIFICIAL SEQUENCE
  Engineered IL-17A binding polypeptide
VDAKYAKEWDEAQWEIWLLPNLTWHQQNAFIRKLIDDPSQSSELLSEAKKLNDSQAPK

SEQ ID NO: 128 - protein, 58 aa, ARTIFICIAL SEQUENCE
  Engineered IL-17A binding polypeptide
VDAKYAKEYDYAWFEIWELPNLTWDQQYAFIQKLNDDPSQSSELLSEAKKLNDSQAPK

SEQ ID NO: 129 - protein, 58 aa, ARTIFICIAL SEQUENCE
  Engineered IL-17A binding polypeptide
VDAKYAKEADEAWWEIWSLPNLTYAQAYAFIQKLLDDPSQSSELLSEAKKLNDSQAPK

SEQ ID NO: 130 - protein, 58 aa, ARTIFICIAL SEQUENCE
  Engineered IL-17A binding polypeptide
VDAKYAKEADFAWFEIWMLPNLTWDQQYAFISKLNDDPSQSSELLSEAKKLNDSQAPK

SEQ ID NO: 131 - protein, 58 aa, ARTIFICIAL SEQUENCE
  Engineered IL-17A binding polypeptide
VDAKYAKEMDEAQWEIWLLPNLTWHQQNAFIRKLLDDPSQSSELLSEAKKLNDSQAPK

SEQ ID NO: 132 - protein, 58 aa, ARTIFICIAL SEQUENCE
  Engineered IL-17A binding polypeptide
VDAKYAKEMDDAQWEIWLLPNLTWAQSNAFIRKLIDDPSQSSELLSEAKKLNDSQAPK

SEQ ID NO: 133 - protein, 58 aa, ARTIFICIAL SEQUENCE
  Engineered IL-17A binding polypeptide
VDAKYAKEMDEAQWEIWTLPNLTWAQSHAFISKLIDDPSQSSELLSEAKKLNDSQAPK

SEQ ID NO: 134 - protein, 58 aa, ARTIFICIAL SEQUENCE
  Engineered IL-17A binding polypeptide
VDAKYAKEADEAWFEIWALPNLTWDQAVAFIHKLNDDPSQSSELLSEAKKLNDSQAPK

SEQ ID NO: 135 - protein, 58 aa, ARTIFICIAL SEQUENCE
  Engineered IL-17A binding polypeptide
VDAKYAKEYDYAWFEIWLLPNLTWVQQTAFIHKLNDDPSQSSELLSEAKKLNDSQAPK

SEQ ID NO: 136 - protein, 58 aa, ARTIFICIAL SEQUENCE
  Engineered IL-17A binding polypeptide
VDAKYAKEADYAWFEIWLLPNLTWDQQYAFIRKLIDDPSQSSELLSEAKKLNDSQAPK

SEQ ID NO: 137 - protein, 58 aa, ARTIFICIAL SEQUENCE
  Engineered IL-17A binding polypeptide
VDAKYAKEADEAWWEIWSLPNLTHDQGVAFIRKLLDDPSQSSELLSEAKKLNDSQAPK

SEQ ID NO: 138 - protein, 58 aa, ARTIFICIAL SEQUENCE
  Engineered IL-17A binding polypeptide
VDAKYAKEMDEAQWEIWLLPNLTWAQSRAFIQKLIDDPSQSSELLSEAKKLNDSQAPK

SEQ ID NO: 139 - protein, 58 aa, ARTIFICIAL SEQUENCE
  Engineered IL-17A binding polypeptide
VDAKYAKEMDEAWWEIWLLPNLTHDQQFAFISKLIDDPSQSSELLSEAKKLNDSQAPK

SEQ ID NO: 140 - protein, 58 aa, ARTIFICIAL SEQUENCE
  Engineered IL-17A binding polypeptide
VDAKYAKEYDYAWFEIWTLPNLTWDQQKAFIHKLNDDPSQSSELLSEAKKLNDSQAPK

SEQ ID NO: 141 - protein, 58 aa, ARTIFICIAL SEQUENCE
  Engineered IL-17A binding polypeptide
VDAKYAKEMDYAQWEIWLLPNLTWDQQHAFISKLIDDPSQSSELLSEAKKLNDSQAPK

SEQ ID NO: 142 - protein, 58 aa, ARTIFICIAL SEQUENCE
  Engineered IL-17A binding polypeptide
VDAKYAKEHDDAWFEIWLLPNLTWDQAYAFIVKLNDDPSQSSELLSEAKKLNDSQAPK

SEQ ID NO: 143 - protein, 58 aa, ARTIFICIAL SEQUENCE
  Engineered IL-17A binding polypeptide
VDAKYAKEMGYAQLEIWLLPNLTWHQSNAFIRKLIDDPSQSSELLSEAKKLNDSQAPK

SEQ ID NO: 144 - protein, 58 aa, ARTIFICIAL SEQUENCE
  Engineered IL-17A binding polypeptide
VDAKYAKEMDEAQWEIWLLPNLTHDQQTAFIRKLIDDPSQSSELLSEAKKLNDSQAPK

SEQ ID NO: 145 - protein, 58 aa, ARTIFICIAL SEQUENCE
  Engineered IL-17A binding polypeptide
VDAKYAKEMDYAQWEIWLLPNLTWDQGNAFIRKLIDDPSQSSELLSEAKKLNDSQAPK

SEQ ID NO: 146 - protein, 58 aa, ARTIFICIAL SEQUENCE
  Engineered IL-17A binding polypeptide
VDAKYAKEMDFAQWEIWTLPNLTWDQSNAFIRKLIDDPSQSSELLSEAKKLNDSQAPK

SEQ ID NO: 147 - protein, 58 aa, ARTIFICIAL SEQUENCE
  Engineered IL-17A binding polypeptide
VDAKYAKEADYAWWEIWALPNLTHAQQVAFIQKLLDDPSQSSELLSEAKKLNDSQAPK

SEQ ID NO: 148 - protein, 58 aa, ARTIFICIAL SEQUENCE
  Engineered IL-17A binding polypeptide
VDAKYAKEMDYAQWEIWLLPNLTYDQGHAFIQKLLDDPSQSSELLSEAKKLNDSQAPK

SEQ ID NO: 149 - protein, 58 aa, ARTIFICIAL SEQUENCE
  Engineered IL-17A binding polypeptide
VDAKYAKEMDDAQWEIWLLPNLTWAQSHAFIVKLIDDPSQSSELLSEAKKLNDSQAPK

SEQ ID NO: 150 - protein, 58 aa, ARTIFICIAL SEQUENCE
  Engineered IL-17A binding polypeptide
VDAKYAKEYDQAWFEIWMLPNLTHRQQRAFIHKLNDDPSQSSELLSEAKKLNDSQAPK

SEQ ID NO: 151 - protein, 58 aa, ARTIFICIAL SEQUENCE
  Engineered IL-17A binding polypeptide
VDAKYAKEMDNAQWEIWMLPNLTWDQGRAFIVKLIDDPSQSSELLSEAKKLNDSQAPK

SEQ ID NO: 152 - protein, 58 aa, ARTIFICIAL SEQUENCE
  Engineered IL-17A binding polypeptide
VDAKYAKEHDEAWFEIWMLPNLTWHQARAFIVKLNDDPSQSSELLSEAKKLNDSQAPK

SEQ ID NO: 153 - protein, 58 aa, ARTIFICIAL SEQUENCE
  Engineered IL-17A binding polypeptide
VDAKYAKEMDDAQIEIWMLPNLTWAQGHAFIRKLIDDPSQSSELLSEAKKLNDSQAPK

SEQ ID NO: 154 - protein, 58 aa, ARTIFICIAL SEQUENCE
  Engineered IL-17A binding polypeptide
VDAKYAKEADYAQWEIWLLPNLTHAQGTAFIQKLIDDPSQSSELLSEAKKLNDSQAPK

SEQ ID NO: 155 - protein, 58 aa, ARTIFICIAL SEQUENCE
  Engineered IL-17A binding polypeptide
VDAKYAKEMDFAQWEIWLLPNLTWDQAHAFIQKLIDDPSQSSELLSEAKKLNDSQAPK

SEQ ID NO: 156 - protein, 58 aa, ARTIFICIAL SEQUENCE
  Engineered IL-17A binding polypeptide
VDAKYAKEYDEAWFEIWSLPNLTYDQQYAFIVKLIDDPSQSSELLSEAKKLNDSQAPK

SEQ ID NO: 157 - protein, 58 aa, ARTIFICIAL SEQUENCE
  Engineered IL-17A binding polypeptide
VDAKYAKEHDYAWFEIWALPNLTHDQQVAFIRKLNDDPSQSSELLSEAKKLNDSQAPK

SEQ ID NO: 158 - protein, 58 aa, ARTIFICIAL SEQUENCE
  Engineered IL-17A binding polypeptide
VDAKYAKEMDYAWFEIWMLPNLTHDQARAFIVKLNDDPSQSSELLSEAKKLNDSQAPK

SEQ ID NO: 159 - protein, 58 aa, ARTIFICIAL SEQUENCE
  Engineered IL-17A binding polypeptide
VDAKYAKEMDEAWWEIWTLPNLTYAQARAFIVKLIDDPSQSSELLSEAKKLNDSQAPK

SEQ ID NO: 160 - protein, 58 aa, ARTIFICIAL SEQUENCE
  Engineered IL-17A binding polypeptide
VDAKYAKEMDEAQWEIWLLPNLTWVQQNAFISKLIDDPSQSSELLSEAKKLNDSQAPK

SEQ ID NO: 161 - protein, 58 aa, ARTIFICIAL SEQUENCE
  Engineered IL-17A binding polypeptide
VDAKYAKEMDDAQWEIWMLPNLTWAQGNAFIRKLLDDPSQSSELLSEAKKLNDSQAPK

SEQ ID NO: 162 - protein, 58 aa, ARTIFICIAL SEQUENCE
  Engineered IL-17A binding polypeptide
VDAKYAKEMDEAQWEIWLLPNLTWHQQNAFIQKLIDDPSQSSELLSEAKKLNDSQAPK

SEQ ID NO: 163 - protein, 58 aa, ARTIFICIAL SEQUENCE
  Engineered IL-17A binding polypeptide
VDAKYAKEADNAQWEIWLLPNLTWAQGHAFIQKLIDDPSQSSELLSEAKKLNDSQAPK

SEQ ID NO: 164 - protein, 58 aa, ARTIFICIAL SEQUENCE
  Engineered IL-17A binding polypeptide
VDAKYAKEMDEAQWEIWLLPNLTWAQQNAFISKLIDDPSQSSELLSEAKKLNDSQAPK

SEQ ID NO: 165 - protein, 58 aa, ARTIFICIAL SEQUENCE
  Engineered IL-17A binding polypeptide
VDAKYAKEMDDAWFEIWLLPNLTWDQQYAFIQKLIDDPSQSSELLSEAKKLNDSQAPK

SEQ ID NO: 166 - protein, 58 aa, ARTIFICIAL SEQUENCE
  Engineered IL-17A binding polypeptide
VDAKYAKEMDFAQWEIWLLPNLTWHQQNAFIRKLIDDPSQSSELLSEAKKLNDSQAPK

SEQ ID NO: 167 - protein, 58 aa, ARTIFICIAL SEQUENCE
  Engineered IL-17A binding polypeptide
VDAKYAKEHAEAWFEIWALPNLTHAQQYAFIHKLNDDPSQSSELLSEAKKLNDSQAPK

SEQ ID NO: 168 - protein, 58 aa, ARTIFICIAL SEQUENCE
  Engineered IL-17A binding polypeptide
VDAKYAKEMDEAQWEIWMLPNLTWHQQHAFIRKLIDDPSQSSELLSEAKKLNDSQAPK

SEQ ID NO: 169 - protein, 58 aa, ARTIFICIAL SEQUENCE
  Engineered IL-17A binding polypeptide
VDAKYAKEMDYAQWEIWMLPNLTWDQQHAFIVKLLDDPSQSSELLSEAKKLNDSQAPK

SEQ ID NO: 170 - protein, 58 aa, ARTIFICIAL SEQUENCE
  Engineered IL-17A binding polypeptide
VDAKYAKEMDDAQWEIWMLPNLTWDQGNAFIRKLIDDPSQSSELLSEAKKLNDSQAPK

SEQ ID NO: 171 - protein, 58 aa, ARTIFICIAL SEQUENCE
  Engineered IL-17A binding polypeptide
VDAKYAKEHDQAWFEIWALPNLTHAQAVAFIVKLNDDPSQSSELLSEAKKLNDSQAPK

SEQ ID NO: 172 - protein, 58 aa, ARTIFICIAL SEQUENCE
  Engineered IL-17A binding polypeptide
VDAKYAKEADEAWWEIWLLPNLTHDQQYAFIVKLLDDPSQSSELLSEAKKLNDSQAPK

SEQ ID NO: 173 - protein, 58 aa, ARTIFICIAL SEQUENCE
  Engineered IL-17A binding polypeptide
VDAKYAKEMDYAWFEIWALPNLTYDQQYAFISKLLDDPSQSSELLSEAKKLNDSQAPK

SEQ ID NO: 174 - protein, 58 aa, ARTIFICIAL SEQUENCE
  Engineered IL-17A binding polypeptide
VDAKYAKEADFAWWEIWSLPNLTHHQAKAFIVKLIDDPSQSSELLSEAKKLNDSQAPK

SEQ ID NO: 175 - protein, 58 aa, ARTIFICIAL SEQUENCE
  Engineered IL-17A binding polypeptide
VDAKYAKEMDYAQWEIWMLPNLTWDQSHAFIQKLIDDPSQSSELLSEAKKLNDSQAPK

SEQ ID NO: 176 - protein, 58 aa, ARTIFICIAL SEQUENCE
  Engineered IL-17A binding polypeptide
VDAKYAKEMDDAQWEIWMLPNLTHDQGKAFIQKLIDDPSQSSELLSEAKKLNDSQAPK

SEQ ID NO: 177 - protein, 58 aa, ARTIFICIAL SEQUENCE
  Engineered IL-17A binding polypeptide
VDAKYAKEADEAWFEIWMLPNLTYAQQVAFIRKLNDDPSQSSELLSEAKKLNDSQAPK

SEQ ID NO: 178 - protein, 58 aa, ARTIFICIAL SEQUENCE
  Engineered IL-17A binding polypeptide
VDAKYAKEMDEAQWEIWLLPNLTYAQQSAFIQKLIDDPSQSSELLSEAKKLNDSQAPK

SEQ ID NO: 179 - protein, 58 aa, ARTIFICIAL SEQUENCE
  Engineered IL-17A binding polypeptide
VDAKYAKEMDFAQWEIWLLPNLTWDQQHAFIQKLIDDPSQSSELLSEAKKLNDSQAPK

SEQ ID NO: 180 - protein, 58 aa, ARTIFICIAL SEQUENCE
  Engineered IL-17A binding polypeptide
VDAKYAKEMDDAWWEIWALPNLTYDQQYAFIAKLIDDPSQSSELLSEAKKLNDSQAPK

SEQ ID NO: 181 - protein, 58 aa, ARTIFICIAL SEQUENCE
  Engineered IL-17A binding polypeptide
VDAKYAKEMDEAQWEIWMLPNLTWDQSHAFIQKLIDDPSQSSELLSEAKKLNDSQAPK

SEQ ID NO: 182 - protein, 58 aa, ARTIFICIAL SEQUENCE
  Engineered IL-17A binding polypeptide
VDAKYAKEHDYAWFEIWLLPNLTYDQQHAFIVKLNDDPSQSSELLSEAKKLNDSQAPK

SEQ ID NO: 183 - protein, 58 aa, ARTIFICIAL SEQUENCE
  Engineered IL-17A binding polypeptide
VDAKYAKEMDYAWWEIWLLPNLTHDQAKAFIQKLLDDPSQSSELLSEAKKLNDSQAPK

SEQ ID NO: 184 - protein, 58 aa, ARTIFICIAL SEQUENCE
  Engineered IL-17A binding polypeptide
VDAKYAKEADEAQWEIWTLPNLTWDQGHAFIRKLIDDPSQSSELLSEAKKLNDSQAPK

SEQ ID NO: 185 - protein, 58 aa, ARTIFICIAL SEQUENCE
  Engineered IL-17A binding polypeptide
VDAKYAKEMDYAQWEIWLLPNLTHAQQNAFIQKLIDDPSQSSELLSEAKKLNDSQAPK

SEQ ID NO: 186 - protein, 58 aa, ARTIFICIAL SEQUENCE
  Engineered IL-17A binding polypeptide
VDAKYAKEADYAWWEIWLLPNLTHAQQTAFIHKLLDDPSQSSELLSEAKKLNDSQAPK

SEQ ID NO: 187 - protein, 58 aa, ARTIFICIAL SEQUENCE
  Engineered IL-17A binding polypeptide
VDAKYAKEMDYAQWEIWMLPNLTHAQSRAFIQKLIDDPSQSSELLSEAKKLNDSQAPK

SEQ ID NO: 188 - protein, 58 aa, ARTIFICIAL SEQUENCE
  Engineered IL-17A binding polypeptide
VDAKYAKEYDYAWFEIWALPNLTHHQQVAFIRKLNDDPSQSSELLSEAKKLNDSQAPK

SEQ ID NO: 189 - protein, 58 aa, ARTIFICIAL SEQUENCE
  Engineered IL-17A binding polypeptide
VDAKYAKEMDDAWWEIWLLPNLTHDQQRAFIQKLLDDPSQSSELLSEAKKLNDSQAPK

SEQ ID NO: 190 - protein, 58 aa, ARTIFICIAL SEQUENCE
  Engineered IL-17A binding polypeptide
VDAKYAKEMDNAWWEIWTLPNLTHAQARAFIVKLLDDPSQSSELLSEAKKLNDSQAPK

SEQ ID NO: 191 - protein, 58 aa, ARTIFICIAL SEQUENCE
  Engineered IL-17A binding polypeptide
VDAKYAKEMDFAQWEIWLLPNLTHHQQNAFIRKLIDDPSQSSELLSEAKKLNDSQAPK

SEQ ID NO: 192 - protein, 58 aa, ARTIFICIAL SEQUENCE
  Engineered IL-17A binding polypeptide
VDAKYAKEADQAWWEIWALPNLTHDQAVAFIRKLIDDPSQSSELLSEAKKLNDSQAPK

SEQ ID NO: 193 - protein, 58 aa, ARTIFICIAL SEQUENCE
  Engineered IL-17A binding polypeptide
VDAKYAKEYDYAWFEIWALPNLTRAQATAFISKLNDDPSQSSELLSEAKKLNDSQAPK

SEQ ID NO: 194 - protein, 58 aa, ARTIFICIAL SEQUENCE
  Engineered IL-17A binding polypeptide
VDAKYAKEADYAWFEIWSLPNLTYAQQVAFIRKLNDDPSQSSELLSEAKKLNDSQAPK

SEQ ID NO: 195 - protein, 58 aa, ARTIFICIAL SEQUENCE
  Engineered IL-17A binding polypeptide
VDAKYAKEAGYAWFEIWSLPNLTHRQQVAFIRKLNDDPSQSSELLSEAKKLNDSQAPK

SEQ ID NO: 196 - protein, 58 aa, ARTIFICIAL SEQUENCE
  Engineered IL-17A binding polypeptide
VDAKYAKEHGDAWFEIWLLPNLTWDQQRAFIVKLNDDPSQSSELLSEAKKLNDSQAPK

SEQ ID NO: 197 - protein, 58 aa, ARTIFICIAL SEQUENCE
  Engineered IL-17A binding polypeptide
VDAKYAKEADEAWFEIWALPNLTHDQGKAFIRKLLDDPSQSSELLSEAKKLNDSQAPK

SEQ ID NO: 198 - protein, 58 aa, ARTIFICIAL SEQUENCE
  Engineered IL-17A binding polypeptide
VDAKYAKEADYAWWEIWLLPNLTHDQARAFISKLNDDPSQSSELLSEAKKLNDSQAPK

SEQ ID NO: 199 - protein, 58 aa, ARTIFICIAL SEQUENCE
  Engineered IL-17A binding polypeptide
VDAKYAKEADEAWWEIWALPNLTHAQQVAFIRKLIDDPSQSSELLSEAKKLNDSQAPK

SEQ ID NO: 200 - protein, 58 aa, ARTIFICIAL SEQUENCE
  Engineered IL-17A binding polypeptide
VDAKYAKEADYAWFEIWSLPNLTWDQSRAFIGKLNDDPSQSSELLSEAKKLNDSQAPK

SEQ ID NO: 201 - protein, 58 aa, ARTIFICIAL SEQUENCE
  Engineered IL-17A binding polypeptide
VDAKYAKEMDFAWFEIWALPNLTHVQQVAFIRKLIDDPSQSSELLSEAKKLNDSQAPK

SEQ ID NO: 202 - protein, 58 aa, ARTIFICIAL SEQUENCE
  Engineered IL-17A binding polypeptide
VDAKYAKEADEAWFEIWALPNLTYDQSKAFIRKLIDDPSQSSELLSEAKKLNDSQAPK

SEQ ID NO: 203 - protein, 58 aa, ARTIFICIAL SEQUENCE
  Engineered IL-17A binding polypeptide
VDAKYAKEADYAWFEIWALPNLTHAQQYAFIQKLNDDPSQSSELLSEAKKLNDSQAPK

SEQ ID NO: 204 - protein, 58 aa, ARTIFICIAL SEQUENCE
  Engineered IL-17A binding polypeptide
VDAKYAKEYLYAWMEIWTLPNLTWDQARAFIVKLLDDPSQSSELLSEAKKLNDSQAPK

SEQ ID NO: 205 - protein, 58 aa, ARTIFICIAL SEQUENCE
  Engineered IL-17A binding polypeptide
VDAKYAKEYDFAWFEIWALPNLTHDQGKAFISKLNDDPSQSSELLSEAKKLNDSQAPK

SEQ ID NO: 206 - protein, 58 aa, ARTIFICIAL SEQUENCE
  Engineered IL-17A binding polypeptide
VDAKYAKEADYAWWEIWSLPNLTHAQAYAFIRKLIDDPSQSSELLSEAKKLNDSQAPK

SEQ ID NO: 207 - protein, 58 aa, ARTIFICIAL SEQUENCE
  Engineered IL-17A binding polypeptide
VDAKYAKEADYAWWEIWALPNLTHAQAVAFIQKLLDDPSQSSELLSEAKKLNDSQAPK

SEQ ID NO: 208 - protein, 58 aa, ARTIFICIAL SEQUENCE
  Engineered IL-17A binding polypeptide
VDAKYAKEMDYAWWEIWLLPNLTHDQQVAFIRKLIDDPSQSSELLSEAKKLNDSQAPK

SEQ ID NO: 209 - protein, 58 aa, ARTIFICIAL SEQUENCE
  Engineered IL-17A binding polypeptide
VDAKYAKEWDYAWWEIWALPNLTHDQARAFIIKLNDDPSQSSELLSEAKKLNDSQAPK

SEQ ID NO: 210 - protein, 58 aa, ARTIFICIAL SEQUENCE
  Engineered IL-17A binding polypeptide
VDAKYAKEMDFAWWEIWSLPNLTHAQARAFIVKLIDDPSQSSELLSEAKKLNDSQAPK

SEQ ID NO: 211 - protein, 58 aa, ARTIFICIAL SEQUENCE
  Engineered IL-17A binding polypeptide
VDAKYAKEADYAWWEIWALPNLTHAQQVAFISKLLDDPSQSSELLSEAKKLNDSQAPK

SEQ ID NO: 212 - protein, 58 aa, ARTIFICIAL SEQUENCE
  Engineered IL-17A binding polypeptide
VDAKYAKEADYAWWEIWSLPNLTHAQAKAFIQKLIDDPSQSSELLSEAKKLNDSQAPK

SEQ ID NO: 213 - protein, 58 aa, ARTIFICIAL SEQUENCE
  Engineered IL-17A binding polypeptide
VDAKYAKEHDYAWFEIWMLPNLTHAQQVAFIHKLNDDPSQSSELLSEAKKLNDSQAPK

SEQ ID NO: 214 - protein, 58 aa, ARTIFICIAL SEQUENCE
  Engineered IL-17A binding polypeptide
VDAKYAKEMDYAWFEIWDLPNLTYDQAVAFIHKLNDDPSQSSELLSEAKKLNDSQAPK

SEQ ID NO: 215 - protein, 58 aa, ARTIFICIAL SEQUENCE
  Engineered IL-17A binding polypeptide
VDAKYAKEYDYAWFEIWALPNLTHAQQVAFIQKLIDDPSQSSELLSEAKKLNDSQAPK

SEQ ID NO: 216 - protein, 58 aa, ARTIFICIAL SEQUENCE
  Engineered IL-17A binding polypeptide
VDAKYAKEYDYAWFEIWLLPNLTYDQQRAFIVKLNDDPSQSSELLSEAKKLNDSQAPK

SEQ ID NO: 217 - protein, 58 aa, ARTIFICIAL SEQUENCE
  Engineered IL-17A binding polypeptide
VDAKYAKEHDYAWFEIWSLPNLTWDQQVAFIRKLNDDPSQSSELLSEAKKLNDSQAPK

SEQ ID NO: 218 - protein, 58 aa, ARTIFICIAL SEQUENCE
  Engineered IL-17A binding polypeptide
VDAKYAKEYDEAWWEIWLLPNLTHDQAYAFIHKLNDDPSQSSELLSEAKKLNDSQAPK

SEQ ID NO: 219 - protein, 58 aa, ARTIFICIAL SEQUENCE
  Engineered IL-17A binding polypeptide
VDAKYAKEMDYAQFEIWLLPNLTWAQSNAFIRKLIDDPSQSSELLSEAKKLNDSQAPK

SEQ ID NO: 220 - protein, 58 aa, ARTIFICIAL SEQUENCE
  Engineered IL-17A binding polypeptide
VDAKYAKEADYAWFEIWDLPNLTYDQQYAFIRKLLDDPSQSSELLSEAKKLNDSQAPK

SEQ ID NO: 221 - protein, 58 aa, ARTIFICIAL SEQUENCE
  Engineered IL-17A binding polypeptide
VDAKYAKEMDYAWFEIWALPNLTHDQAVAFIQKLLDDPSQSSELLSEAKKLNDSQAPK

SEQ ID NO: 222 - protein, 58 aa, ARTIFICIAL SEQUENCE
  Engineered IL-17A binding polypeptide
VDAKYAKEADYAWFEIWALPNLTHAQQTAFIRKLNDDPSQSSELLSEAKKLNDSQAPK

SEQ ID NO: 223 - protein, 58 aa, ARTIFICIAL SEQUENCE
  Engineered IL-17A binding polypeptide
VDAKYAKEADYAQWEIWLLPNLTWDQGHAFIQKLIDDPSQSSELLSEAKKLNDSQAPK

SEQ ID NO: 224 - protein, 58 aa, ARTIFICIAL SEQUENCE
  Engineered IL-17A binding polypeptide
VDAKYAKEMDYAWFEIWLLPNLTYDQQHAFIRKLLDDPSQSSELLSEAKKLNDSQAPK

SEQ ID NO: 225 - protein, 58 aa, ARTIFICIAL SEQUENCE
  Engineered IL-17A binding polypeptide
VDAKYAKEMDEAQWEIWLLPNLTWVQGNAFIRKLLDDPSQSSELLSEAKKLNDSQAPK

SEQ ID NO: 226 - protein, 58 aa, ARTIFICIAL SEQUENCE
  Engineered IL-17A binding polypeptide
VDAKYAKEYDNAWFEIWLLPNLTHDQQRAFIVKLNDDPSQSSELLSEAKKLNDSQAPK

SEQ ID NO: 227 - protein, 58 aa, ARTIFICIAL SEQUENCE
  Engineered IL-17A binding polypeptide
VDAKYAKEMDEAQWEIWMLPNLTYDQGHAFIRKLIDDPSQSSELLSEAKKLNDSQAPK

SEQ ID NO: 228 - protein, 58 aa, ARTIFICIAL SEQUENCE
  Engineered IL-17A binding polypeptide
VDAKYAKEMDFAQLEIWTLPNLTWAQGHAFIQKLIDDPSQSSELLSEAKKLNDSQAPK

SEQ ID NO: 229 - protein, 58 aa, ARTIFICIAL SEQUENCE
  Engineered IL-17A binding polypeptide
VDAKYAKEHDYAWFEIWLLPNLTWDQQTAFIHKLNDDPSQSSELLSEAKKLNDSQAPK

SEQ ID NO: 230 - protein, 58 aa, ARTIFICIAL SEQUENCE
  Engineered IL-17A binding polypeptide
VDAKYAKEMDQAQWEIWLLPNLTWHQSHAFISKLIDDPSQSSELLSEAKKLNDSQAPK

SEQ ID NO: 231 - protein, 58 aa, ARTIFICIAL SEQUENCE
  Engineered IL-17A binding polypeptide
VDAKYAKEADYAWFEIWALPNLTHDQARAFIRKLIDDPSQSSELLSEAKKLNDSQAPK

SEQ ID NO: 232 - protein, 58 aa, ARTIFICIAL SEQUENCE
  Engineered IL-17A binding polypeptide
VDAKYAKEMDDAQWEIWLLPNLTWDQQHAFIVKLIDDPSQSSELLSEAKKLNDSQAPK

SEQ ID NO: 233 - protein, 58 aa, ARTIFICIAL SEQUENCE
  Engineered IL-17A binding polypeptide
VDAKYAKEYDDAWFEIWLLPNLTWDQQYAFIHKLNDDPSQSSELLSEAKKLNDSQAPK

SEQ ID NO: 234 - protein, 58 aa, ARTIFICIAL SEQUENCE
  Engineered IL-17A binding polypeptide
VDAKYAKEMDEAWWEIWLLPNLTYAQQYAFIQKLLDDPSQSSELLSEAKKLNDSQAPK

SEQ ID NO: 235 - protein, 58 aa, ARTIFICIAL SEQUENCE
  Engineered IL-17A binding polypeptide
VDAKYAKEADYAWFEIWSLPNLTHAQAYAFIVKLIDDPSQSSELLSEAKKLNDSQAPK

SEQ ID NO: 236 - protein, 58 aa, ARTIFICIAL SEQUENCE
  Engineered IL-17A binding polypeptide
VDAKYAKEMDDAQWEIWMLPNLTWDQSHAFIAKLIDDPSQSSELLSEAKKLNDSQAPK

SEQ ID NO: 237 - protein, 58 aa, ARTIFICIAL SEQUENCE
  Engineered IL-17A binding polypeptide
VDAKYAKEMDYAQWEIWMLPNLTWDQSNAFIRKLIDDPSQSSELLSEAKKLNDSQAPK

SEQ ID NO: 238 - protein, 58 aa, ARTIFICIAL SEQUENCE
  Engineered IL-17A binding polypeptide
VDAKYAKEADYAWWEIWALPNLTHDQARAFIVKLLDDPSQSSELLSEAKKLNDSQAPK

SEQ ID NO: 239 - protein, 58 aa, ARTIFICIAL SEQUENCE
  Engineered IL-17A binding polypeptide
VDAKYAKEADYAWWEIWLLPNLTWDQQRAFIIKLNDDPSQSSELLSEAKKLNDSQAPK

SEQ ID NO: 240 - protein, 58 aa, ARTIFICIAL SEQUENCE
  Engineered IL-17A binding polypeptide
VDAKYAKEADEAQWEIWLLPNLTYDQGTAFIRKLIDDPSQSSELLSEAKKLNDSQAPK

SEQ ID NO: 241 - protein, 58 aa, ARTIFICIAL SEQUENCE
  Engineered IL-17A binding polypeptide
VDAKYAKEMDEAQWEIWLLPNLTWDQQHAFIQKLLDDPSQSSELLSEAKKLNDSQAPK

SEQ ID NO: 242 - protein, 58 aa, ARTIFICIAL SEQUENCE
  Engineered IL-17A binding polypeptide
VDAKYAKEYDEAWFEIWTLPNLTHDQARAFIIKLNDDPSQSSELLSEAKKLNDSQAPK

SEQ ID NO: 243 - protein, 58 aa, ARTIFICIAL SEQUENCE
  Engineered IL-17A binding polypeptide
VDAKYAKEMDRAQWEIWLLPNLTWHQQNAFIRKLIDDPSQSSELLSEAKKLNDSQAPK

SEQ ID NO: 244 - protein, 58 aa, ARTIFICIAL SEQUENCE
  Engineered IL-17A binding polypeptide
VDAKYAKEHDFAWWEIWLLPNLTWDQQRAFIVKLNDDPSQSSELLSEAKKLNDSQAPK

SEQ ID NO: 245 - protein, 58 aa, ARTIFICIAL SEQUENCE
  Engineered IL-17A binding polypeptide
VDAKYAKEMDQAQWEIWMLPNLTWDQGHAFIRKLLDDPSQSSELLSEAKKLNDSQAPK

SEQ ID NO: 246 - protein, 58 aa, ARTIFICIAL SEQUENCE
  Engineered IL-17A binding polypeptide
VDAKYAKEADYAWFEIWMLPNLTWDQQRAFIGKLIDDPSQSSELLSEAKKLNDSQAPK

SEQ ID NO: 247 - protein, 58 aa, ARTIFICIAL SEQUENCE
  Engineered IL-17A binding polypeptide
VDAKYAKEADYAWFEIWMLPNLTYDQQRAFIVKLLDDPSQSSELLSEAKKLNDSQAPK

SEQ ID NO: 248 - protein, 58 aa, ARTIFICIAL SEQUENCE
  Engineered IL-17A binding polypeptide
VDAKYAKEMDRAQWEIWLLPNLTWAQSNAFIRKLIDDPSQSSELLSEAKKLNDSQAPK

SEQ ID NO: 249 - protein, 58 aa, ARTIFICIAL SEQUENCE
  Engineered IL-17A binding polypeptide
VDAKYAKEADYAWFEIWMLPNLTWDQQVAFIRKLNDDPSQSSELLSEAKKLNDSQAPK

SEQ ID NO: 250 - protein, 58 aa, ARTIFICIAL SEQUENCE
  Engineered IL-17A binding polypeptide
VDAKYAKEMDNAQWEIWLLPNLTWDQQNAFIRKLIDDPSQSSELLSEAKKLNDSQAPK

SEQ ID NO: 251 - protein, 58 aa, ARTIFICIAL SEQUENCE
  Engineered IL-17A binding polypeptide
VDAKYAKEADEAWWEIWALPNLTYAQGRAFIVKLIDDPSQSSELLSEAKKLNDSQAPK

SEQ ID NO: 252 - protein, 58 aa, ARTIFICIAL SEQUENCE
  Engineered IL-17A binding polypeptide
VDAKYAKEADFAWFEIWLLPNLTWDQQTAFIQKLNDDPSQSSELLSEAKKLNDSQAPK

SEQ ID NO: 253 - protein, 58 aa, ARTIFICIAL SEQUENCE
  Engineered IL-17A binding polypeptide
VDAKYAKEMDDAQWEIWLLPNLTWDQQHAFIQKLLDDPSQSSELLSEAKKLNDSQAPK

SEQ ID NO: 254 - protein, 58 aa, ARTIFICIAL SEQUENCE
  Engineered IL-17A binding polypeptide
VDAKYAKEMNEAQWEIWLLPNLTWDQGHAFIAKLIDDPSQSSELLSEAKKLNDSQAPK

SEQ ID NO: 255 - protein, 58 aa, ARTIFICIAL SEQUENCE
  Engineered IL-17A binding polypeptide
VDAKYAKEMDDAQWEIWMLPNLTWDQQHAFIRKLIDDPSQSSELLSEAKKLNDSQAPK

SEQ ID NO: 256 - protein, 58 aa, ARTIFICIAL SEQUENCE
  Engineered IL-17A binding polypeptide
VDAKYAKEMDYAQWEIWTLPNLTWHQGHAFIQKLLDDPSQSSELLSEAKKLNDSQAPK

SEQ ID NO: 257 - protein, 58 aa, ARTIFICIAL SEQUENCE
  Engineered IL-17A binding polypeptide
VDAKYAKEYDYAWFEIWLLPNLTYAQQRAFIAKLNDDPSQSSELLSEAKKLNDSQAPK

SEQ ID NO: 258 - protein, 58 aa, ARTIFICIAL SEQUENCE
  Engineered IL-17A binding polypeptide
VDAKYAKEMDQAWFEIWLLPNLTYDQQYAFIQKLIDDPSQSSELLSEAKKLNDSQAPK

SEQ ID NO: 259 - protein, 58 aa, ARTIFICIAL SEQUENCE
  Engineered IL-17A binding polypeptide
VDAKYAKEMDNAQWEIWMLPNLTWDQSHAFIVKLLDDPSQSSELLSEAKKLNDSQAPK

SEQ ID NO: 260 - protein, 58 aa, ARTIFICIAL SEQUENCE
  Engineered IL-17A binding polypeptide
VDAKYAKEMDYAWFEIWSLPNLTHAQAVAFIRKLNDDPSQSSELLSEAKKLNDSQAPK

SEQ ID NO: 261 - protein, 58 aa, ARTIFICIAL SEQUENCE
  Engineered IL-17A binding polypeptide
VDAKYAKEADYAWFEIWALPNLTYAQAVAFIRKLNDDPSQSSELLSEAKKLNDSQAPK

SEQ ID NO: 262 - protein, 58 aa, ARTIFICIAL SEQUENCE
  Engineered IL-17A binding polypeptide
VDAKYAKEMDDAQWEIWLLPNLTWHQQNAFIAKLIDDPSQSSELLSEAKKLNDSQAPK

SEQ ID NO: 263 - protein, 58 aa, ARTIFICIAL SEQUENCE
  Engineered IL-17A binding polypeptide
VDAKYAKEHDYAWFEIWMLPNLTWDQQTAFIHKLNDDPSQSSELLSEAKKLNDSQAPK

SEQ ID NO: 264 - protein, 58 aa, ARTIFICIAL SEQUENCE
  Engineered IL-17A binding polypeptide
VDAKYAKEAADAWFEIWLLPNLTHAQQVAFIRKLNDDPSQSSELLSEAKKLNDSQAPK

SEQ ID NO: 265 - protein, 58 aa, ARTIFICIAL SEQUENCE
  Engineered IL-17A binding polypeptide
VDAKYAKEYDYAWFEIWMLPNLTHAQAFAFIQKLNDDPSQSSELLSEAKKLNDSQAPK

SEQ ID NO: 266 - protein, 58 aa, ARTIFICIAL SEQUENCE
  Engineered IL-17A binding polypeptide
VDAKYAKEYDEAWFEIWALPNLTWDQQRAFIVKLNDDPSQSSELLSEAKKLNDSQAPK

SEQ ID NO: 267 - protein, 58 aa, ARTIFICIAL SEQUENCE
  Engineered IL-17A binding polypeptide
VDAKYAKEMDDAWFEIWMLPNLTHDQAYAFIQKLIDDPSQSSELLSEAKKLNDSQAPK

SEQ ID NO: 268 - protein, 58 aa, ARTIFICIAL SEQUENCE
  Engineered IL-17A binding polypeptide
VDAKYAKEMGEAQLEIWMLPNLTWDQGNAFIRKLIDDPSQSSELLSEAKKLNDSQAPK

SEQ ID NO: 269 - protein, 58 aa, ARTIFICIAL SEQUENCE
  Engineered IL-17A binding polypeptide
VDAKYAKEMDDAQWEIWLLPNLTYDQGTAFIRKLIDDPSQSSELLSEAKKLNDSQAPK

SEQ ID NO: 270 - protein, 58 aa, ARTIFICIAL SEQUENCE
  Engineered IL-17A binding polypeptide
VDAKYAKEAGEAWFEIWLLPNLTYDQAYAFIRKLNDDPSQSSELLSEAKKLNDSQAPK

SEQ ID NO: 271 - protein, 58 aa, ARTIFICIAL SEQUENCE
  Engineered IL-17A binding polypeptide
VDAKYAKEYDDAWFEIWLLPNLTHAQAKAFIHKLNDDPSQSSELLSEAKKLNDSQAPK

SEQ ID NO: 272 - protein, 58 aa, ARTIFICIAL SEQUENCE
  Engineered IL-17A binding polypeptide
VDAKYAKEADYAWFEIWMLPNLTHDQAYAFIQKLNDDPSQSSELLSEAKKLNDSQAPK

SEQ ID NO: 273 - protein, 58 aa, ARTIFICIAL SEQUENCE
  Engineered IL-17A binding polypeptide
VDAKYAKEMDYAWFEIWLLPNLTYDQQYAFIQKLIDDPSQSSELLSEAKKLNDSQAPK

SEQ ID NO: 274 - protein, 58 aa, ARTIFICIAL SEQUENCE
  Engineered IL-17A binding polypeptide
VDAKYAKEYDYAWFEIWTLPNLTHDQQYAFIRKLNDDPSQSSELLSEAKKLNDSQAPK

SEQ ID NO: 275 - protein, 58 aa, ARTIFICIAL SEQUENCE
  Engineered IL-17A binding polypeptide
VDAKYAKEYDYAWFEIWLLPNLTHAQASAFIVKLNDDPSQSSELLSEAKKLNDSQAPK

SEQ ID NO: 276 - protein, 58 aa, ARTIFICIAL SEQUENCE
  Engineered IL-17A binding polypeptide
VDAKYAKEMGDAQWEIWLLPNLTWHQQNAFIAKLIDDPSQSSELLSEAKKLNDSQAPK

SEQ ID NO: 277 - protein, 58 aa, ARTIFICIAL SEQUENCE
  Engineered IL-17A binding polypeptide
VDAKYAKEADFAWFEIWTLPNLTHDQQRAFIVKLLDDPSQSSELLSEAKKLNDSQAPK

SEQ ID NO: 278 - protein, 58 aa, ARTIFICIAL SEQUENCE
  Engineered IL-17A binding polypeptide
VDAKYAKEHDYAWFEIWALPNLTWDQAVAFIHKLNDDPSQSSELLSEAKKLNDSQAPK

SEQ ID NO: 279 - protein, 58 aa, ARTIFICIAL SEQUENCE
  Engineered IL-17A binding polypeptide
VDAKYAKEHDNAWFEIWLLPNLTYDQQVAFIHKLNDDPSQSSELLSEAKKLNDSQAPK

SEQ ID NO: 280 - protein, 58 aa, ARTIFICIAL SEQUENCE
  Engineered IL-17A binding polypeptide
VDAKYAKEMDEAQWEIWLLPNLTHDQSRAFIQKLIDDPSQSSELLSEAKKLNDSQAPK

SEQ ID NO: 281 - protein, 58 aa, ARTIFICIAL SEQUENCE
  Engineered IL-17A binding polypeptide
VDAKYAKEADEAWFEIWALPNLTHAQAVAFIRKLNDDPSQSSELLSEAKKLNDSQAPK

SEQ ID NO: 282 - protein, 58 aa, ARTIFICIAL SEQUENCE
  Engineered IL-17A binding polypeptide
VDAKYAKEMDYAQWEIWSLPNLTWDQGNAFIRKLIDDPSQSSELLSEAKKLNDSQAPK

SEQ ID NO: 283 - protein, 58 aa, ARTIFICIAL SEQUENCE
  Engineered IL-17A binding polypeptide
VDAKYAKEAAEAQLEIWLLPNLTWDQGHAFIIKLIDDPSQSSELLSEAKKLNDSQAPK

SEQ ID NO: 284 - protein, 58 aa, ARTIFICIAL SEQUENCE
  Engineered IL-17A binding polypeptide
VDAKYAKEMAYAQWEIWLLPNLTWHQSNAFIRKLIDDPSQSSELLSEAKKLNDSQAPK

SEQ ID NO: 285 - protein, 58 aa, ARTIFICIAL SEQUENCE
  Engineered IL-17A binding polypeptide
VDAKYAKEMDNAQWEIWMLPNLTWHQQHAFIQKLIDDPSQSSELLSEAKKLNDSQAPK

SEQ ID NO: 286 - protein, 58 aa, ARTIFICIAL SEQUENCE
  Engineered IL-17A binding polypeptide
VDAKYAKEYDQAWFEIWLLPNLTWDQAYAFIQKLNDDPSQSSELLSEAKKLNDSQAPK

SEQ ID NO: 287 - protein, 58 aa, ARTIFICIAL SEQUENCE
  Engineered IL-17A binding polypeptide
VDAKYAKEWDYAWFEIWELPNLTWDQARAFIIKLNDDPSQSSELLSEAKKLNDSQAPK

SEQ ID NO: 288 - protein, 58 aa, ARTIFICIAL SEQUENCE
  Engineered IL-17A binding polypeptide
VDAKYAKEADYAWFEIWSLPNLTWDQQRAFIHKLNDDPSQSSELLSEAKKLNDSQAPK

SEQ ID NO: 289 - protein, 58 aa, ARTIFICIAL SEQUENCE
  Engineered IL-17A binding polypeptide
VDAKYAKEADFAQWEIWLLPNLTWDQGHAFIQKLIDDPSQSSELLSEAKKLNDSQAPK

SEQ ID NO: 290 - protein, 58 aa, ARTIFICIAL SEQUENCE
  Engineered IL-17A binding polypeptide
VDAKYAKEYDEAWFEIWLLPNLTYDQQRAFIIKLNDDPSQSSELLSEAKKLNDSQAPK

SEQ ID NO: 291 - protein, 58 aa, ARTIFICIAL SEQUENCE
  Engineered IL-17A binding polypeptide
VDAKYAKEMDDAQWEIWMLPNLTWDQGHAFIRKLLDDPSQSSELLSEAKKLNDSQAPK

SEQ ID NO: 292 - protein, 58 aa, ARTIFICIAL SEQUENCE
  Engineered IL-17A binding polypeptide
VDAKYAKEMDEAWWEIWTLPNLTYDQQYAFIAKLLDDPSQSSELLSEAKKLNDSQAPK

SEQ ID NO: 293 - protein, 58 aa, ARTIFICIAL SEQUENCE
  Engineered IL-17A binding polypeptide
VDAKYAKEADDAQWEIWLLPNLTWDQSHAFIQKLIDDPSQSSELLSEAKKLNDSQAPK

SEQ ID NO: 294 - protein, 58 aa, ARTIFICIAL SEQUENCE
  Engineered IL-17A binding polypeptide
VDAKYAKEMDDAWFEIWLLPNLTYDQQYAFIQKLIDDPSQSSELLSEAKKLNDSQAPK

SEQ ID NO: 295 - protein, 58 aa, ARTIFICIAL SEQUENCE
  Engineered IL-17A binding polypeptide
VDAKYAKEMDEAQWEIWMLPNLTWAQSHAFIQKLIDDPSQSSELLSEAKKLNDSQAPK

SEQ ID NO: 296 - protein, 58 aa, ARTIFICIAL SEQUENCE
  Engineered IL-17A binding polypeptide
VDAKYAKEYDFAWFEIWLLPNLTWAQQRAFISKLNDDPSQSSELLSEAKKLNDSQAPK

SEQ ID NO: 297 - protein, 58 aa, ARTIFICIAL SEQUENCE
  Engineered IL-17A binding polypeptide
VDAKYAKEHANAWFEIWLLPNLTYDQQVAFIRKLNDDPSQSSELLSEAKKLNDSQAPK

SEQ ID NO: 298 - protein, 58 aa, ARTIFICIAL SEQUENCE
  Engineered IL-17A binding polypeptide
VDAKYAKEYDNAWFEIWLLPNLTYDQATAFIHKLNDDPSQSSELLSEAKKLNDSQAPK

SEQ ID NO: 299 - protein, 58 aa, ARTIFICIAL SEQUENCE
  Engineered IL-17A binding polypeptide
VDAKYAKEWDEAWFEIWALPNLTHAQARAFIQKLIDDPSQSSELLSEAKKLNDSQAPK

SEQ ID NO: 300 - protein, 58 aa, ARTIFICIAL SEQUENCE
  Engineered IL-17A binding polypeptide
VDAKYAKEYDFAWFEIWLLPNLTYDQAVAFIRKLNDDPSQSSELLSEAKKLNDSQAPK

SEQ ID NO: 301 - protein, 58 aa, ARTIFICIAL SEQUENCE
  Engineered IL-17A binding polypeptide
VDAKYAKEADYAWFEIWALPNLTHAQQRAFIIKLNDDPSQSSELLSEAKKLNDSQAPK

SEQ ID NO: 302 - protein, 58 aa, ARTIFICIAL SEQUENCE
  Engineered IL-17A binding polypeptide
VDAKYAKEADYAWWEIWLLPNLTYDQQRAFIVKLNDDPSQSSELLSEAKKLNDSQAPK

SEQ ID NO: 303 - protein, 58 aa, ARTIFICIAL SEQUENCE
  Engineered IL-17A binding polypeptide
VDAKYAKEHDYAWFEIWLLPNLTWDQQKAFIAKLNDDPSQSSELLSEAKKLNDSQAPK

SEQ ID NO: 304 - protein, 58 aa, ARTIFICIAL SEQUENCE
  Engineered IL-17A binding polypeptide
VDAKYAKEADYAWFEIWMLPNLTYDQAVAFIIKLNDDPSQSSELLSEAKKLNDSQAPK

SEQ ID NO: 305 - protein, 58 aa, ARTIFICIAL SEQUENCE
  Engineered IL-17A binding polypeptide
VDAKYAKEMDFAQWEIWTLPNLTWDQSHAFISKLIDDPSQSSELLSEAKKLNDSQAPK

SEQ ID NO: 306 - protein, 58 aa, ARTIFICIAL SEQUENCE
  Engineered IL-17A binding polypeptide
VDAKYAKEMGEAQIEIWLLPNLTYDQGHAFIQKLIDDPSQSSELLSEAKKLNDSQAPK

SEQ ID NO: 307 - protein, 58 aa, ARTIFICIAL SEQUENCE
  Engineered IL-17A binding polypeptide
VDAKYAKEADYAWFEIWALPNLTYDQARAFIQKLLDDPSQSSELLSEAKKLNDSQAPK

SEQ ID NO: 308 - protein, 58 aa, ARTIFICIAL SEQUENCE
  Engineered IL-17A binding polypeptide
VDAKYAKEADYAWWEIWSLPNLTHAQARAFIVKLIDDPSQSSELLSEAKKLNDSQAPK

SEQ ID NO: 309 - protein, 58 aa, ARTIFICIAL SEQUENCE
  Engineered IL-17A binding polypeptide
VDAKYAKEYDQAWFEIWLLPNLTHDQAKAFIIKLNDDPSQSSELLSEAKKLNDSQAPK

SEQ ID NO: 310 - protein, 58 aa, ARTIFICIAL SEQUENCE
  Engineered IL-17A binding polypeptide
VDAKYAKEADEAWWEIWTLPNLTWDQQHAFIRKLIDDPSQSSELLSEAKKLNDSQAPK

SEQ ID NO: 311 - protein, 58 aa, ARTIFICIAL SEQUENCE
  Engineered IL-17A binding polypeptide
VDAKYAKEMDYAQWEIWMLPNLTWDQQHAFIRKLIDDPSQSSELLSEAKKLNDSQAPK

SEQ ID NO: 312 - protein, 58 aa, ARTIFICIAL SEQUENCE
  Engineered IL-17A binding polypeptide
VDAKYAKEYDFAQWEIWLLPNLTWDQSHAFIQKLIDDPSQSSELLSEAKKLNDSQAPK

SEQ ID NO: 313 - protein, 58 aa, ARTIFICIAL SEQUENCE
  Engineered IL-17A binding polypeptide
VDAKYAKEADYAWFEIWLLPNLTWDQQTAFISKLNDDPSQSSELLSEAKKLNDSQAPK

SEQ ID NO: 314 - protein, 58 aa, ARTIFICIAL SEQUENCE
  Engineered IL-17A binding polypeptide
VDAKYAKEMDYAQWEIWLLPNLTWHQSNAFIRKLIDDPSQSSELLSEAKKLNDSQAPK

SEQ ID NO: 315 - protein, 58 aa, ARTIFICIAL SEQUENCE
  Engineered IL-17A binding polypeptide
VDAKYAKEHAEAWFEIWALPNLTWDQARAFIVKLNDDPSQSSELLSEAKKLNDSQAPK

SEQ ID NO: 316 - protein, 58 aa, ARTIFICIAL SEQUENCE
  Engineered IL-17A binding polypeptide
VDAKYAKEADYAWFEIWALPNLTYDQQFAFIRKLLDDPSQSSELLSEAKKLNDSQAPK

SEQ ID NO: 317 - protein, 58 aa, ARTIFICIAL SEQUENCE
  Engineered IL-17A binding polypeptide
VDAKYAKEYDNAWFEIWMLPNLTHAQAVAFIRKLNDDPSQSSELLSEAKKLNDSQAPK

SEQ ID NO: 318 - protein, 58 aa, ARTIFICIAL SEQUENCE
  Engineered IL-17A binding polypeptide
VDAKYAKEADFAWWEIWLLPNLTHDQQRAFIVKLLDDPSQSSELLSEAKKLNDSQAPK

SEQ ID NO: 319 - protein, 58 aa, ARTIFICIAL SEQUENCE
  Engineered IL-17A binding polypeptide
VDAKYAKEADFAWFEIWALPNLTHDQAVAFIRKLNDDPSQSSELLSEAKKLNDSQAPK

SEQ ID NO: 320 - protein, 58 aa, ARTIFICIAL SEQUENCE
  Engineered IL-17A binding polypeptide
VDAKYAKEHDYAWFEIWMLPNLTYDQAHAFIRKLNDDPSQSSELLSEAKKLNDSQAPK

SEQ ID NO: 321 - protein, 58 aa, ARTIFICIAL SEQUENCE
  Engineered IL-17A binding polypeptide
VDAKYAKEADEAWWEIWLLPNLTYDQQHAFIVKLIDDPSQSSELLSEAKKLNDSQAPK

SEQ ID NO: 322 - protein, 58 aa, ARTIFICIAL SEQUENCE
  Engineered IL-17A binding polypeptide
VDAKYAKEMDYAWWEIWLLPNLTHDQAYAFIVKLIDDPSQSSELLSEAKKLNDSQAPK

SEQ ID NO: 323 - protein, 58 aa, ARTIFICIAL SEQUENCE
  Engineered IL-17A binding polypeptide
VDAKYAKEYLYAWFEIWTLPNLTYDQQVAFIRKLLDDPSQSSELLSEAKKLNDSQAPK

SEQ ID NO: 324 - protein, 58 aa, ARTIFICIAL SEQUENCE
  Engineered IL-17A binding polypeptide
VDAKYAKEYDDAWFEIWTLPNLTRDQQTAFIIKLNDDPSQSSELLSEAKKLNDSQAPK

SEQ ID NO: 325 - protein, 58 aa, ARTIFICIAL SEQUENCE
  Engineered IL-17A binding polypeptide
VDAKYAKEMDEAWFEIWSLPNLTYAQQYAFIVKLIDDPSQSSELLSEAKKLNDSQAPK

SEQ ID NO: 326 - protein, 58 aa, ARTIFICIAL SEQUENCE
  Engineered IL-17A binding polypeptide
VDAKYAKEADYAWFEIWSLPNLTHVQQVAFIRKLLDDPSQSSELLSEAKKLNDSQAPK

SEQ ID NO: 327 - protein, 58 aa, ARTIFICIAL SEQUENCE
  Engineered IL-17A binding polypeptide
VDAKYAKEADEAWFEIWSLPNLTHAQARAFIQKLIDDPSQSSELLSEAKKLNDSQAPK

SEQ ID NO: 328 - protein, 58 aa, ARTIFICIAL SEQUENCE
  Engineered IL-17A binding polypeptide
VDAKYAKEYDEAWFEIWMLPNLTRDQASAFIIKLNDDPSQSSELLSEAKKLNDSQAPK

SEQ ID NO: 329 - protein, 58 aa, ARTIFICIAL SEQUENCE
  Engineered IL-17A binding polypeptide
VDAKYAKEHADAWFEIWSLPNLTHVQARAFIIKLNDDPSQSSELLSEAKKLNDSQAPK

SEQ ID NO: 330 - protein, 58 aa, ARTIFICIAL SEQUENCE
  Engineered IL-17A binding polypeptide
VDAKYAKEADFAWWEIWLLPNLTHAQQTAFIRKLLDDPSQSSELLSEAKKLNDSQAPK

SEQ ID NO: 331 - protein, 58 aa, ARTIFICIAL SEQUENCE
  Engineered IL-17A binding polypeptide
VDAKYAKEADYAWFEIWSLPNLTHAQATAFISKLNDDPSQSSELLSEAKKLNDSQAPK

SEQ ID NO: 332 - protein, 58 aa, ARTIFICIAL SEQUENCE
  Engineered IL-17A binding polypeptide
VDAKYAKEYDYAWFEIWELPNLTWDQQTAFIRKLNDDPSQSSELLSEAKKLNDSQAPK

SEQ ID NO: 333 - protein, 58 aa, ARTIFICIAL SEQUENCE
  Engineered IL-17A binding polypeptide
VDAKYAKEADYAWWEIWLLPNLTHDQATAFIRKLIDDPSQSSELLSEAKKLNDSQAPK

SEQ ID NO: 334 - protein, 58 aa, ARTIFICIAL SEQUENCE
  Engineered IL-17A binding polypeptide
VDAKYAKEADYAWWEIWSLPNLTHDQQVAFIRKLNDDPSQSSELLSEAKKLNDSQAPK

SEQ ID NO: 335 - protein, 58 aa, ARTIFICIAL SEQUENCE
  Engineered IL-17A binding polypeptide
VDAKYAKEADFAWWEIWSLPNLTHVQQVAFIRKLLDDPSQSSELLSEAKKLNDSQAPK

SEQ ID NO: 336 - protein, 58 aa, ARTIFICIAL SEQUENCE
  Engineered IL-17A binding polypeptide
VDAKYAKEADYAWFEIWALPNLTHAQQVAFIAKLNDDPSQSSELLSEAKKLNDSQAPK

SEQ ID NO: 337 - protein, 58 aa, ARTIFICIAL SEQUENCE
  Engineered IL-17A binding polypeptide
VDAKYAKEADYAWFEIWALPNLTHAQAVAFIGKLNDDPSQSSELLSEAKKLNDSQAPK

SEQ ID NO: 338 - protein, 58 aa, ARTIFICIAL SEQUENCE
  Engineered IL-17A binding polypeptide
VDAKYAKEADFAWFEIWSLPNLTHDQARAFISKLNDDPSQSSELLSEAKKLNDSQAPK

SEQ ID NO: 339 - protein, 58 aa, ARTIFICIAL SEQUENCE
  Engineered IL-17A binding polypeptide
VDAKYAKEMDEAQWEIWLLPNLTHHQANAFIRKLIDDPSQSSELLSEAKKLNDSQAPK

SEQ ID NO: 340 - protein, 58 aa, ARTIFICIAL SEQUENCE
  Engineered IL-17A binding polypeptide
VDAKYAKEADYAWFEIWALPNLTWDQAHAFIRKLNDDPSQSSELLSEAKKLNDSQAPK

SEQ ID NO: 341 - protein, 58 aa, ARTIFICIAL SEQUENCE
  Engineered IL-17A binding polypeptide
VDAKYAKEADQAWWEIWLLPNLTHDQQVAFIQKLLDDPSQSSELLSEAKKLNDSQAPK

SEQ ID NO: 342 - protein, 58 aa, ARTIFICIAL SEQUENCE
  Engineered IL-17A binding polypeptide
VDAKYAKEADEAWWEIWSLPNLTHDQAKAFIQKLLDDPSQSSELLSEAKKLNDSQAPK

SEQ ID NO: 343 - protein, 58 aa, ARTIFICIAL SEQUENCE
  Engineered IL-17A binding polypeptide
VDAKYAKEHGYAWFEIWALPNLTHDQAKAFIRKLNDDPSQSSELLSEAKKLNDSQAPK

SEQ ID NO: 344 - protein, 58 aa, ARTIFICIAL SEQUENCE
  Engineered IL-17A binding polypeptide
VDAKYAKEADYAWWEIWSLPNLTHVQQVAFIRKLIDDPSQSSELLSEAKKLNDSQAPK

SEQ ID NO: 345 - protein, 58 aa, ARTIFICIAL SEQUENCE
  Engineered IL-17A binding polypeptide
VDAKYAKEYDEAWFEIWMLPNLTYDQGRAFIGKLNDDPSQSSELLSEAKKLNDSQAPK

SEQ ID NO: 346 - protein, 58 aa, ARTIFICIAL SEQUENCE
  Engineered IL-17A binding polypeptide
VDAKYAKEADFAWWEIWALPNLTHVQAVAFIRKLLDDPSQSSELLSEAKKLNDSQAPK

SEQ ID NO: 347 - protein, 58 aa, ARTIFICIAL SEQUENCE
  Engineered IL-17A binding polypeptide
VDAKYAKEADDAWFEIWALPNLTHAQAVAFIQKLNDDPSQSSELLSEAKKLNDSQAPK

SEQ ID NO: 348 - protein, 58 aa, ARTIFICIAL SEQUENCE
  Engineered IL-17A binding polypeptide
VDAKYAKEADQAWWEIWALPNLTHDQGVAFIRKLLDDPSQSSELLSEAKKLNDSQAPK

SEQ ID NO: 349 - protein, 58 aa, ARTIFICIAL SEQUENCE
  Engineered IL-17A binding polypeptide
VDAKYAKEYDEAWFEIWLLPNLTADQARAFIVKLNDDPSQSSELLSEAKKLNDSQAPK

SEQ ID NO: 350 - protein, 58 aa, ARTIFICIAL SEQUENCE
  Engineered IL-17A binding polypeptide
VDAKYAKEADYAWWEIWALPNLTYDQQYAFIRKLNDDPSQSSELLSEAKKLNDSQAPK

SEQ ID NO: 351 - protein, 58 aa, ARTIFICIAL SEQUENCE
  Engineered IL-17A binding polypeptide
VDAKYAKEADDAWWEIWMLPNLTHDQARAFIQKLLDDPSQSSELLSEAKKLNDSQAPK

SEQ ID NO: 352 - protein, 58 aa, ARTIFICIAL SEQUENCE
  Engineered IL-17A binding polypeptide
VDAKYAKEADEAWWEIWALPNLTHRQQVAFIQKLLDDPSQSSELLSEAKKLNDSQAPK

SEQ ID NO: 353 - protein, 58 aa, ARTIFICIAL SEQUENCE
  Engineered IL-17A binding polypeptide
VDAKYAKEADFAWFEIWALPNLTHDQATAFIVKLNDDPSQSSELLSEAKKLNDSQAPK

SEQ ID NO: 354 - protein, 58 aa, ARTIFICIAL SEQUENCE
  Engineered IL-17A binding polypeptide
VDAKYAKEMDDAWWEIWALPNLTHAQAVAFIRKLLDDPSQSSELLSEAKKLNDSQAPK

SEQ ID NO: 355 - protein, 58 aa, ARTIFICIAL SEQUENCE
  Engineered IL-17A binding polypeptide
VDAKYAKEADEAWWEIWALPNLTHHQAVAFIHKLLDDPSQSSELLSEAKKLNDSQAPK

SEQ ID NO: 356 - protein, 58 aa, ARTIFICIAL SEQUENCE
  Engineered IL-17A binding polypeptide
VDAKYAKEADYAWWEIWTLPNLTHDQQYAFIQKLLDDPSQSSELLSEAKKLNDSQAPK

SEQ ID NO: 357 - protein, 58 aa, ARTIFICIAL SEQUENCE
  Engineered IL-17A binding polypeptide
VDAKYAKEMDFAQWEIWLLPNLTWHQSNAFIRKLLDDPSQSSELLSEAKKLNDSQAPK

SEQ ID NO: 358 - protein, 58 aa, ARTIFICIAL SEQUENCE
  Engineered IL-17A binding polypeptide
VDAKYAKEWDEAWFEIWSLPNLTYDQGRAFIIKLNDDPSQSSELLSEAKKLNDSQAPK

SEQ ID NO: 359 - protein, 58 aa, ARTIFICIAL SEQUENCE
  Engineered IL-17A binding polypeptide
VDAKYAKEADEAQWEIWLLPNLTHDQSNAFIRKLIDDPSQSSELLSEAKKLNDSQAPK

SEQ ID NO: 360 - protein, 58 aa, ARTIFICIAL SEQUENCE
  Engineered IL-17A binding polypeptide
VDAKYAKEADYAWWEIWALPNLTHAQQKAFIRKLLDDPSQSSELLSEAKKLNDSQAPK

SEQ ID NO: 361 - protein, 58 aa, ARTIFICIAL SEQUENCE
  Engineered IL-17A binding polypeptide
VDAKYAKEMDEAQWEIWMLPNLTWDQSHAFIAKLLDDPSQSSELLSEAKKLNDSQAPK

SEQ ID NO: 362 - protein, 58 aa, ARTIFICIAL SEQUENCE
  Engineered IL-17A binding polypeptide
VDAKYAKEADYAWWEIWSLPNLTHDQQVAFIRKLLDDPSQSSELLSEAKKLNDSQAPK

SEQ ID NO: 363 - protein, 58 aa, ARTIFICIAL SEQUENCE
  Engineered IL-17A binding polypeptide
VDAKYAKEMDDAWWEIWLLPNLTYDQQYAFIQKLLDDPSQSSELLSEAKKLNDSQAPK

SEQ ID NO: 364 - protein, 58 aa, ARTIFICIAL SEQUENCE
  Engineered IL-17A binding polypeptide
VDAKYAKEMDDAQWEIWLLPNLTWVQQNAFIRKLIDDPSQSSELLSEAKKLNDSQAPK

SEQ ID NO: 365 - protein, 58 aa, ARTIFICIAL SEQUENCE
  Engineered IL-17A binding polypeptide
VDAKYAKEMDEAQWEIWLLPNLTWHQQNAFIRKLIDDPSQSSELLSEAKKLNDSQAPK

SEQ ID NO: 366 - protein, 58 aa, ARTIFICIAL SEQUENCE
  Engineered IL-17A binding polypeptide
VDAKYAKEHDYAWFEIWALPNLTHAQAVAFIIKLNDDPSQSSELLSEAKKLNDSQAPK

SEQ ID NO: 367 - protein, 58 aa, ARTIFICIAL SEQUENCE
  Engineered IL-17A binding polypeptide
VDAKYAKEADFAWWEIWLLPNLTYDQQHAFIVKLIDDPSQSSELLSEAKKLNDSQAPK

SEQ ID NO: 368 - protein, 58 aa, ARTIFICIAL SEQUENCE
  Engineered IL-17A binding polypeptide
VDAKYAKEMLDAQWEIWMLPNLTWDQGHAFIVKLIDDPSQSSELLSEAKKLNDSQAPK

SEQ ID NO: 369 - protein, 58 aa, ARTIFICIAL SEQUENCE
  Engineered IL-17A binding polypeptide
VDAKYAKEMDNAWFEIWTLPNLTYAQQHAFIVKLIDDPSQSSELLSEAKKLNDSQAPK

SEQ ID NO: 370 - protein, 58 aa, ARTIFICIAL SEQUENCE
  Engineered IL-17A binding polypeptide
VDAKYAKEADYAWFEIWTLPNLTYDQQKAFIQKLIDDPSQSSELLSEAKKLNDSQAPK

SEQ ID NO: 371 - protein, 58 aa, ARTIFICIAL SEQUENCE
  Engineered IL-17A binding polypeptide
VDAKYAKEMDEAQIEIWLLPNLTWHQGNAFIRKLLDDPSQSSELLSEAKKLNDSQAPK

SEQ ID NO: 372 - protein, 58 aa, ARTIFICIAL SEQUENCE
  Engineered IL-17A binding polypeptide
VDAKYAKEMDNAQWEIWLLPNLTYDQSHAFIAKLIDDPSQSSELLSEAKKLNDSQAPK

SEQ ID NO: 373 - protein, 58 aa, ARTIFICIAL SEQUENCE
  Engineered IL-17A binding polypeptide
VDAKYAKEADFAWFEIWSLPNLTHDQAVAFIRKLNDDPSQSSELLSEAKKLNDSQAPK

SEQ ID NO: 374 - protein, 58 aa, ARTIFICIAL SEQUENCE
  Engineered IL-17A binding polypeptide
VDAKYAKEMDYAQWEIWMLPNLTWDQQHAFIQKLIDDPSQSSELLSEAKKLNDSQAPK

SEQ ID NO: 375 - protein, 58 aa, ARTIFICIAL SEQUENCE
  Engineered IL-17A binding polypeptide
VDAKYAKEADYAWFEIWMLPNLTWDQQTAFISKLIDDPSQSSELLSEAKKLNDSQAPK

SEQ ID NO: 376 - protein, 58 aa, ARTIFICIAL SEQUENCE
  Engineered IL-17A binding polypeptide
VDAKYAKEMDYAQWEIWLLPNLTHAQGTAFIRKLIDDPSQSSELLSEAKKLNDSQAPK

SEQ ID NO: 377 - protein, 58 aa, ARTIFICIAL SEQUENCE
  Engineered IL-17A binding polypeptide
VDAKYAKEMDYAWFEIWALPNLTYDQAHAFIIKLIDDPSQSSELLSEAKKLNDSQAPK

SEQ ID NO: 378 - protein, 58 aa, ARTIFICIAL SEQUENCE
  Engineered IL-17A binding polypeptide
VDAKYAKEMDEAWWEIWTLPNLTYDQQHAFIVKLLDDPSQSSELLSEAKKLNDSQAPK

SEQ ID NO: 379 - protein, 58 aa, ARTIFICIAL SEQUENCE
  Engineered IL-17A binding polypeptide
VDAKYAKEADQAWWEIWLLPNLTHDQQVAFIRKLLDDPSQSSELLSEAKKLNDSQAPK

SEQ ID NO: 380 - protein, 58 aa, ARTIFICIAL SEQUENCE
  Engineered IL-17A binding polypeptide
VDAKYAKEADEAWWEIWALPNLTHDQAKAFIIKLLDDPSQSSELLSEAKKLNDSQAPK

SEQ ID NO: 381 - protein, 58 aa, ARTIFICIAL SEQUENCE
  Engineered IL-17A binding polypeptide
VDAKYAKEAAEAWFEIWMLPNLTYDQAVAFIHKLNDDPSQSSELLSEAKKLNDSQAPK

SEQ ID NO: 382 - protein, 58 aa, ARTIFICIAL SEQUENCE
  Engineered IL-17A binding polypeptide
VDAKYAKEADYAWFEIWLLPNLTHVQQRAFIQKLNDDPSQSSELLSEAKKLNDSQAPK

SEQ ID NO: 383 - protein, 58 aa, ARTIFICIAL SEQUENCE
  Engineered IL-17A binding polypeptide
VDAKYAKEMDQAWFEIWALPNLTWHQARAFIVKLIDDPSQSSELLSEAKKLNDSQAPK

SEQ ID NO: 384 - protein, 58 aa, ARTIFICIAL SEQUENCE
  Engineered IL-17A binding polypeptide
VDAKYAKEHDEAWFEIWSLPNLTYDQQRAFIIKLNDDPSQSSELLSEAKKLNDSQAPK

SEQ ID NO: 385 - protein, 58 aa, ARTIFICIAL SEQUENCE
  Engineered IL-17A binding polypeptide
VDAKYAKEYDEAWFEIWMLPNLTYDQAVAFISKLNDDPSQSSELLSEAKKLNDSQAPK

SEQ ID NO: 386 - protein, 58 aa, ARTIFICIAL SEQUENCE
  Engineered IL-17A binding polypeptide
VDAKYAKEHDQAWFEIWLLPNLTYAQARAFISKLNDDPSQSSELLSEAKKLNDSQAPK

SEQ ID NO: 387 - protein, 58 aa, ARTIFICIAL SEQUENCE
  Engineered IL-17A binding polypeptide
VDAKYAKEMDFAQWEIWLLPNLTWHQSNAFIQKLIDDPSQSSELLSEAKKLNDSQAPK

SEQ ID NO: 388 - protein, 58 aa, ARTIFICIAL SEQUENCE
  Engineered IL-17A binding polypeptide
VDAKYAKEMDFAQWEIWMLPNLTWDQSNAFIQKLIDDPSQSSELLSEAKKLNDSQAPK

SEQ ID NO: 389 - protein, 58 aa, ARTIFICIAL SEQUENCE
  Engineered IL-17A binding polypeptide
VDAKYAKEMDNAQWEIWLLPNLTWAQQNAFIRKLIDDPSQSSELLSEAKKLNDSQAPK

SEQ ID NO: 390 - protein, 58 aa, ARTIFICIAL SEQUENCE
  Engineered IL-17A binding polypeptide
VDAKYAKEADYAWFEIWMLPNLTYDQAFAFIQKLIDDPSQSSELLSEAKKLNDSQAPK

SEQ ID NO: 391 - protein, 58 aa, ARTIFICIAL SEQUENCE
  Engineered IL-17A binding polypeptide
VDAKYAKEMDYAQWEIWLLPNLTWVQSHAFIQKLIDDPSQSSELLSEAKKLNDSQAPK

SEQ ID NO: 392 - protein, 58 aa, ARTIFICIAL SEQUENCE
  Engineered IL-17A binding polypeptide
VDAKYAKEADFAWWEIWALPNLTHVQAKAFIQKLIDDPSQSSELLSEAKKLNDSQAPK

SEQ ID NO: 393 - protein, 58 aa, ARTIFICIAL SEQUENCE
  Engineered IL-17A binding polypeptide
VDAKYAKEMDYAQWEIWLLPNLTWDQSHAFIVKLLDDPSQSSELLSEAKKLNDSQAPK

SEQ ID NO: 394 - protein, 58 aa, ARTIFICIAL SEQUENCE
  Engineered IL-17A binding polypeptide
VDAKYAKEADFAWWEIWLLPNLTHDQAYAFIVKLIDDPSQSSELLSEAKKLNDSQAPK

SEQ ID NO: 395 - protein, 58 aa, ARTIFICIAL SEQUENCE
  Engineered IL-17A binding polypeptide
VDAKYAKEMDNAQWEIWLLPNLTYAQQHAFIQKLIDDPSQSSELLSEAKKLNDSQAPK

SEQ ID NO: 396 - protein, 58 aa, ARTIFICIAL SEQUENCE
  Engineered IL-17A binding polypeptide
VDAKYAKEADYAWWEIWSLPNLTHVQARAFIIKLLDDPSQSSELLSEAKKLNDSQAPK

SEQ ID NO: 397 - protein, 58 aa, ARTIFICIAL SEQUENCE
  Engineered IL-17A binding polypeptide
VDAKYAKEHDEAWFEIWTLPNLTHAQARAFISKLNDDPSQSSELLSEAKKLNDSQAPK

SEQ ID NO: 398 - protein, 58 aa, ARTIFICIAL SEQUENCE
  Engineered IL-17A binding polypeptide
VDAKYAKEADYAWFEIWLLPNLTYDQQYAFIQKLNDDPSQSSELLSEAKKLNDSQAPK

SEQ ID NO: 399 - protein, 58 aa, ARTIFICIAL SEQUENCE
  Engineered IL-17A binding polypeptide
VDAKYAKEMDRAQWEIWLLPNLTYDQSHAFIQKLLDDPSQSSELLSEAKKLNDSQAPK

SEQ ID NO: 400 - protein, 58 aa, ARTIFICIAL SEQUENCE
  Engineered IL-17A binding polypeptide
VDAKYAKEMDEAWWEIWLLPNLTYDQQYAFIAKLIDDPSQSSELLSEAKKLNDSQAPK

SEQ ID NO: 401 - protein, 58 aa, ARTIFICIAL SEQUENCE
  Engineered IL-17A binding polypeptide
VDAKYAKEYDYAWFEIWLLPNLTWHQQVAFIHKLNDDPSQSSELLSEAKKLNDSQAPK

SEQ ID NO: 402 - protein, 58 aa, ARTIFICIAL SEQUENCE
  Engineered IL-17A binding polypeptide
VDAKYAKEADFAWFEIWSLPNLTWDQARAFIIKLNDDPSQSSELLSEAKKLNDSQAPK

SEQ ID NO: 403 - protein, 58 aa, ARTIFICIAL SEQUENCE
  Engineered IL-17A binding polypeptide
VDAKYAKEADFAWFEIWLLPNLTWDQQKAFIHKLNDDPSQSSELLSEAKKLNDSQAPK

SEQ ID NO: 404 - protein, 58 aa, ARTIFICIAL SEQUENCE
  Engineered IL-17A binding polypeptide
VDAKYAKEYDQAWFEIWLLPNLTWAQQVAFIQKLNDDPSQSSELLSEAKKLNDSQAPK

SEQ ID NO: 405 - protein, 58 aa, ARTIFICIAL SEQUENCE
  Engineered IL-17A binding polypeptide
VDAKYAKEMDDAQWEIWLLPNLTWDQQHAFIAKLIDDPSQSSELLSEAKKLNDSQAPK

SEQ ID NO: 406 - protein, 58 aa, ARTIFICIAL SEQUENCE
  Engineered IL-17A binding polypeptide
VDAKYAKEMDEAQWEIWLLPNLTWDQGHAFIQKLLDDPSQSSELLSEAKKLNDSQAPK

SEQ ID NO: 407 - protein, 58 aa, ARTIFICIAL SEQUENCE
  Engineered IL-17A binding polypeptide
VDAKYAKEADYAWFEIWMLPNLTHDQQYAFIHKLNDDPSQSSELLSEAKKLNDSQAPK

SEQ ID NO: 408 - protein, 58 aa, ARTIFICIAL SEQUENCE
  Engineered IL-17A binding polypeptide
VDAKYAKEADYAWFEIWALPNLTHVQQVAFIHKLNDDPSQSSELLSEAKKLNDSQAPK

SEQ ID NO: 409 - protein, 58 aa, ARTIFICIAL SEQUENCE
  Engineered IL-17A binding polypeptide
VDAKYAKEADYAWWEIWALPNLTHAQQVAFIRKLLDDPSQSSELLSEAKKLNDSQAPK

SEQ ID NO: 410 - protein, 58 aa, ARTIFICIAL SEQUENCE
  Engineered IL-17A binding polypeptide
VDAKYAKEMGQAQLEIWMLPNLTWDQGHAFIQKLIDDPSQSSELLSEAKKLNDSQAPK

SEQ ID NO: 411 - protein, 58 aa, ARTIFICIAL SEQUENCE
  Engineered IL-17A binding polypeptide
VDAKYAKEMDEAQWEIWLLPNLTWHQSHAFISKLIDDPSQSSELLSEAKKLNDSQAPK

SEQ ID NO: 412 - protein, 58 aa, ARTIFICIAL SEQUENCE
  Engineered IL-17A binding polypeptide
VDAKYAKEMDYAQWEIWLLPNLTWHQQHAFIVKLLDDPSQSSELLSEAKKLNDSQAPK

SEQ ID NO: 413 - protein, 58 aa, ARTIFICIAL SEQUENCE
  Engineered IL-17A binding polypeptide
VDAKYAKEADEAQWEIWLLPNLTWDQSNAFIRKLIDDPSQSSELLSEAKKLNDSQAPK

SEQ ID NO: 414 - protein, 58 aa, ARTIFICIAL SEQUENCE
  Engineered IL-17A binding polypeptide
VDAKYAKEYDYAWFEIWLLPNLTRDQQRAFIIKLNDDPSQSSELLSEAKKLNDSQAPK

SEQ ID NO: 415 - protein, 58 aa, ARTIFICIAL SEQUENCE
  Engineered IL-17A binding polypeptide
VDAKYAKEHAEAWFEIWALPNLTWVQARAFIVKLNDDPSQSSELLSEAKKLNDSQAPK

SEQ ID NO: 416 - protein, 58 aa, ARTIFICIAL SEQUENCE
  Engineered IL-17A binding polypeptide
VDAKYAKEADYAWFEIWLLPNLTYHQQVAFIHKLNDDPSQSSELLSEAKKLNDSQAPK

SEQ ID NO: 417 - protein, 58 aa, ARTIFICIAL SEQUENCE
  Engineered IL-17A binding polypeptide
VDAKYAKEYDFAWFEIWLLPNLTWDQQVAFISKLNDDPSQSSELLSEAKKLNDSQAPK

SEQ ID NO: 418 - protein, 58 aa, ARTIFICIAL SEQUENCE
  Engineered IL-17A binding polypeptide
VDAKYAKEMDEAQWEIWLLPNLTWDQSNAFIRKLLDDPSQSSELLSEAKKLNDSQAPK

SEQ ID NO: 419 - protein, 58 aa, ARTIFICIAL SEQUENCE
  Engineered IL-17A binding polypeptide
VDAKYAKEMDEAQIEIWLLPNLTWAQGHAFIQKLIDDPSQSSELLSEAKKLNDSQAPK

SEQ ID NO: 420 - protein, 58 aa, ARTIFICIAL SEQUENCE
  Engineered IL-17A binding polypeptide
VDAKYAKEADYAWFEIWLLPNLTYHQQYAFIQKLNDDPSQSSELLSEAKKLNDSQAPK

SEQ ID NO: 421 - protein, 58 aa, ARTIFICIAL SEQUENCE
  Engineered IL-17A binding polypeptide
VDAKYAKEMDEAQWEIWLLPNLTWDQQNAFIRKLIDDPSQSSELLSEAKKLNDSQAPK

SEQ ID NO: 422 - protein, 58 aa, ARTIFICIAL SEQUENCE
  Engineered IL-17A binding polypeptide
VDAKYAKEYDQAWFEIWLLPNLTYAQQFAFIRKLNDDPSQSSELLSEAKKLNDSQAPK

SEQ ID NO: 423 - protein, 58 aa, ARTIFICIAL SEQUENCE
  Engineered IL-17A binding polypeptide
VDAKYAKEMGEAQLEIWLLPNLTWHQQNAFIRKLIDDPSQSSELLSEAKKLNDSQAPK

SEQ ID NO: 424 - protein, 58 aa, ARTIFICIAL SEQUENCE
  Engineered IL-17A binding polypeptide
VDAKYAKEMDYAQWEIWLLPNLTYDQQHAFIVKLIDDPSQSSELLSEAKKLNDSQAPK

SEQ ID NO: 425 - protein, 58 aa, ARTIFICIAL SEQUENCE
  Engineered IL-17A binding polypeptide
VDAKYAKEMDEAWWEIWLLPNLTYAQGRAFIVKLLDDPSQSSELLSEAKKLNDSQAPK

SEQ ID NO: 426 - protein, 58 aa, ARTIFICIAL SEQUENCE
  Engineered IL-17A binding polypeptide
VDAKYAKEMDEAWWEIWLLPNLTYDQQYAFISKLIDDPSQSSELLSEAKKLNDSQAPK

SEQ ID NO: 427 - protein, 58 aa, ARTIFICIAL SEQUENCE
  Engineered IL-17A binding polypeptide
VDAKYAKEYDYAWFEIWMLPNLTYDQQVAFISKLNDDPSQSSELLSEAKKLNDSQAPK

SEQ ID NO: 428 - protein, 58 aa, ARTIFICIAL SEQUENCE
  Engineered IL-17A binding polypeptide
VDAKYAKEMDEAQWEIWMLPNLTWDQQNAFIRKLIDDPSQSSELLSEAKKLNDSQAPK

SEQ ID NO: 429 - protein, 58 aa, ARTIFICIAL SEQUENCE
  Engineered IL-17A binding polypeptide
VDAKYAKEMDFAQWEIWMLPNLTWDQSHAFIQKLIDDPSQSSELLSEAKKLNDSQAPK

SEQ ID NO: 430 - protein, 58 aa, ARTIFICIAL SEQUENCE
  Engineered IL-17A binding polypeptide
VDAKYAKEYDYAWFEIWLLPNLTYDQQHAFIVKLNDDPSQSSELLSEAKKLNDSQAPK

SEQ ID NO: 431 - protein, 58 aa, ARTIFICIAL SEQUENCE
  Engineered IL-17A binding polypeptide
VDAKYAKEADFAWWEIWALPNLTHDQARAFIVKLIDDPSQSSELLSEAKKLNDSQAPK

SEQ ID NO: 432 - protein, 58 aa, ARTIFICIAL SEQUENCE
  Engineered IL-17A binding polypeptide
VDAKYAKEADYAWFEIWLLPNLTYDQATAFISKLNDDPSQSSELLSEAKKLNDSQAPK

SEQ ID NO: 433 - protein, 58 aa, ARTIFICIAL SEQUENCE
  Engineered IL-17A binding polypeptide
VDAKYAKEMDYAQWEIWLLPNLTHDQGRAFIQKLIDDPSQSSELLSEAKKLNDSQAPK

SEQ ID NO: 434 - protein, 58 aa, ARTIFICIAL SEQUENCE
  Engineered IL-17A binding polypeptide
VDAKYAKEMDEAQWEIWLLPNLTWDQGNAFISKLIDDPSQSSELLSEAKKLNDSQAPK

SEQ ID NO: 435 - protein, 58 aa, ARTIFICIAL SEQUENCE
  Engineered IL-17A binding polypeptide
VDAKYAKEADYAWWEIWSLPNLTHAQAYAFIVKLIDDPSQSSELLSEAKKLNDSQAPK

SEQ ID NO: 436 - protein, 58 aa, ARTIFICIAL SEQUENCE
  Engineered IL-17A binding polypeptide
VDAKYAKEYDNAWFEIWALPNLTYAQAYAFIRKLNDDPSQSSELLSEAKKLNDSQAPK

SEQ ID NO: 437 - protein, 58 aa, ARTIFICIAL SEQUENCE
  Engineered IL-17A binding polypeptide
VDAKYAKEMDEAQWEIWMLPNLTYAQSHAFIVKLIDDPSQSSELLSEAKKLNDSQAPK

SEQ ID NO: 438 - protein, 58 aa, ARTIFICIAL SEQUENCE
  Engineered IL-17A binding polypeptide
VDAKYAKEADYAWFEIWMLPNLTRDQATAFIIKLNDDPSQSSELLSEAKKLNDSQAPK

SEQ ID NO: 439 - protein, 58 aa, ARTIFICIAL SEQUENCE
  Engineered IL-17A binding polypeptide
VDAKYAKEADYAWFEIWALPNLTWHQATAFIIKLNDDPSQSSELLSEAKKLNDSQAPK

SEQ ID NO: 440 - protein, 58 aa, ARTIFICIAL SEQUENCE
  Engineered IL-17A binding polypeptide
VDAKYAKEADYAWFEIWALPNLTWDQQRAFISKLNDDPSQSSELLSEAKKLNDSQAPK

SEQ ID NO: 441 - protein, 58 aa, ARTIFICIAL SEQUENCE
  Engineered IL-17A binding polypeptide
VDAKYAKEADYAWWEIWTLPNLTYDQSRAFIVKLLDDPSQSSELLSEAKKLNDSQAPK

SEQ ID NO: 442 - protein, 58 aa, ARTIFICIAL SEQUENCE
  Engineered IL-17A binding polypeptide
VDAKYAKEADYAWFEIWELPNLTHDQAVAFIRKLNDDPSQSSELLSEAKKLNDSQAPK

SEQ ID NO: 443 - protein, 58 aa, ARTIFICIAL SEQUENCE
  Engineered IL-17A binding polypeptide
VDAKYAKEMDEAQWEIWLLPNLTHDQGRAFIQKLIDDPSQSSELLSEAKKLNDSQAPK

SEQ ID NO: 444 - protein, 58 aa, ARTIFICIAL SEQUENCE
  Engineered IL-17A binding polypeptide
VDAKYAKEMDNAQWEIWLLPNLTWHQSNAFIQKLIDDPSQSSELLSEAKKLNDSQAPK

SEQ ID NO: 445 - protein, 58 aa, ARTIFICIAL SEQUENCE
  Engineered IL-17A binding polypeptide
VDAKYAKEMDDAQWEIWLLPNLTWDQSNAFIRKLIDDPSQSSELLSEAKKLNDSQAPK

SEQ ID NO: 446 - protein, 58 aa, ARTIFICIAL SEQUENCE
  Engineered IL-17A binding polypeptide
VDAKYAKEMDFAQWEIWLLPNLTWHQQHAFIVKLLDDPSQSSELLSEAKKLNDSQAPK

SEQ ID NO: 447 - protein, 58 aa, ARTIFICIAL SEQUENCE
  Engineered IL-17A binding polypeptide
VDAKYAKEHGYAWFEIWALPNLTWDQQVAFIIKLNDDPSQSSELLSEAKKLNDSQAPK

SEQ ID NO: 448 - protein, 58 aa, ARTIFICIAL SEQUENCE
  Engineered IL-17A binding polypeptide
VDAKYAKEMDYAQWEIWLLPNLTWAQSNAFIAKLIDDPSQSSELLSEAKKLNDSQAPK

SEQ ID NO: 449 - protein, 58 aa, ARTIFICIAL SEQUENCE
  Engineered IL-17A binding polypeptide
VDAKYAKEMDEAQWEIWMLPNLTWHQSHAFIVKLLDDPSQSSELLSEAKKLNDSQAPK

SEQ ID NO: 450 - protein, 58 aa, ARTIFICIAL SEQUENCE
  Engineered IL-17A binding polypeptide
VDAKYAKEMDFAQWEIWLLPNLTWVQSNAFIRKLIDDPSQSSELLSEAKKLNDSQAPK

SEQ ID NO: 451 - protein, 58 aa, ARTIFICIAL SEQUENCE
  Engineered IL-17A binding polypeptide
VDAKYAKEMDNAQWEIWLLPNLTHDQGNAFIRKLIDDPSQSSELLSEAKKLNDSQAPK

SEQ ID NO: 452 - protein, 58 aa, ARTIFICIAL SEQUENCE
  Engineered IL-17A binding polypeptide
VDAKYAKEYDYAWFEIWLLPNLTWDQATAFIRKLNDDPSQSSELLSEAKKLNDSQAPK

SEQ ID NO: 453 - protein, 58 aa, ARTIFICIAL SEQUENCE
  Engineered IL-17A binding polypeptide
VDAKYAKEMDYAQWEIWLLPNLTYDQQHAFIIKLIDDPSQSSELLSEAKKLNDSQAPK

SEQ ID NO: 454 - protein, 58 aa, ARTIFICIAL SEQUENCE
  Engineered IL-17A binding polypeptide
VDAKYAKEMDQAQWEIWLLPNLTWDQQRAFIVKLIDDPSQSSELLSEAKKLNDSQAPK

SEQ ID NO: 455 - protein, 58 aa, ARTIFICIAL SEQUENCE
  Engineered IL-17A binding polypeptide
VDAKYAKEMDEAQWEIWLLPNLTWHQSHAFIQKLLDDPSQSSELLSEAKKLNDSQAPK

SEQ ID NO: 456 - protein, 58 aa, ARTIFICIAL SEQUENCE
  Engineered IL-17A binding polypeptide
VDAKYAKEYDQAWFEIWLLPNLTWDQAVAFIIKLNDDPSQSSELLSEAKKLNDSQAPK

SEQ ID NO: 457 - protein, 58 aa, ARTIFICIAL SEQUENCE
  Engineered IL-17A binding polypeptide
VDAKYAKEMGDAQWEIWLLPNLTWAQQNAFIRKLIDDPSQSSELLSEAKKLNDSQAPK

SEQ ID NO: 458 - protein, 58 aa, ARTIFICIAL SEQUENCE
  Engineered IL-17A binding polypeptide
VDAKYAKEMDEAQWEIWLLPNLTWAQGHAFISKLLDDPSQSSELLSEAKKLNDSQAPK

SEQ ID NO: 459 - protein, 58 aa, ARTIFICIAL SEQUENCE
  Engineered IL-17A binding polypeptide
VDAKYAKEMDDAQWEIWTLPNLTWHQQNAFIRKLIDDPSQSSELLSEAKKLNDSQAPK

SEQ ID NO: 460 - protein, 58 aa, ARTIFICIAL SEQUENCE
  Engineered IL-17A binding polypeptide
VDAKYAKEADDAWWEIWALPNLTWDQARAFIVKLLDDPSQSSELLSEAKKLNDSQAPK

SEQ ID NO: 461 - protein, 58 aa, ARTIFICIAL SEQUENCE
  Engineered IL-17A binding polypeptide
VDAKYAKEMDFAQWEIWLLPNLTWDQGHAFISKLIDDPSQSSELLSEAKKLNDSQAPK

SEQ ID NO: 462 - protein, 58 aa, ARTIFICIAL SEQUENCE
  Engineered IL-17A binding polypeptide
VDAKYAKEMDFAWFEIWALPNLTYDQQVAFIRKLIDDPSQSSELLSEAKKLNDSQAPK

SEQ ID NO: 463 - protein, 58 aa, ARTIFICIAL SEQUENCE
  Engineered IL-17A binding polypeptide
VDAKYAKEWDEAWFEIWALPNLTYDQAVAFIHKLNDDPSQSSELLSEAKKLNDSQAPK

SEQ ID NO: 464 - protein, 58 aa, ARTIFICIAL SEQUENCE
  Engineered IL-17A binding polypeptide
VDAKYAKEMDNAQWEIWLLPNLTWDQSHAFIVKLLDDPSQSSELLSEAKKLNDSQAPK

SEQ ID NO: 465 - protein, 58 aa, ARTIFICIAL SEQUENCE
  Engineered IL-17A binding polypeptide
VDAKYAKEYDDAWFEIWTLPNLTYVQQYAFIRKLNDDPSQSSELLSEAKKLNDSQAPK

SEQ ID NO: 466 - protein, 58 aa, ARTIFICIAL SEQUENCE
  Engineered IL-17A binding polypeptide
VDAKYAKEHAEAWFEIWSLPNLTWDQQVAFIGKLNDDPSQSSELLSEAKKLNDSQAPK

SEQ ID NO: 467 - protein, 58 aa, ARTIFICIAL SEQUENCE
  Engineered IL-17A binding polypeptide
VDAKYAKEMGEAQWEIWLLPNLTYDQSHAFIVKLLDDPSQSSELLSEAKKLNDSQAPK

SEQ ID NO: 468 - protein, 58 aa, ARTIFICIAL SEQUENCE
  Engineered IL-17A binding polypeptide
VDAKYAKEHDYAWFEIWALPNLTHDQARAFIHKLNDDPSQSSELLSEAKKLNDSQAPK

SEQ ID NO: 469 - protein, 58 aa, ARTIFICIAL SEQUENCE
  Engineered IL-17A binding polypeptide
VDAKYAKEADYAWFEIWALPNLTWDQQRAFIVKLNDDPSQSSELLSEAKKLNDSQAPK

SEQ ID NO: 470 - protein, 58 aa, ARTIFICIAL SEQUENCE
  Engineered IL-17A binding polypeptide
VDAKYAKEADYAWFEIWSLPNLTYHQARAFIQKLIDDPSQSSELLSEAKKLNDSQAPK

SEQ ID NO: 471 - protein, 58 aa, ARTIFICIAL SEQUENCE
  Engineered IL-17A binding polypeptide
VDAKYAKEADYAWFEIWLLPNLTYDQAVAFIGKLNDDPSQSSELLSEAKKLNDSQAPK

SEQ ID NO: 472 - protein, 58 aa, ARTIFICIAL SEQUENCE
  Engineered IL-17A binding polypeptide
VDAKYAKEMDRAQLEIWLLPNLTWAQGNAFIRKLIDDPSQSSELLSEAKKLNDSQAPK

SEQ ID NO: 473 - protein, 58 aa, ARTIFICIAL SEQUENCE
  Engineered IL-17A binding polypeptide
VDAKYAKEMNQAQWEIWLLPNLTWHQSHAFIQKLIDDPSQSSELLSEAKKLNDSQAPK

SEQ ID NO: 474 - protein, 58 aa, ARTIFICIAL SEQUENCE
  Engineered IL-17A binding polypeptide
VDAKYAKEHAEAWFEIWLLPNLTWRQQRAFIIKLNDDPSQSSELLSEAKKLNDSQAPK

SEQ ID NO: 475 - protein, 58 aa, ARTIFICIAL SEQUENCE
  Engineered IL-17A binding polypeptide
VDAKYAKEMDQAQWEIWLLPNLTWDQSHAFISKLLDDPSQSSELLSEAKKLNDSQAPK

SEQ ID NO: 476 - protein, 58 aa, ARTIFICIAL SEQUENCE
  Engineered IL-17A binding polypeptide
VDAKYAKEMDEAQWEIWLLPNLTHAQSHAFIQKLIDDPSQSSELLSEAKKLNDSQAPK

SEQ ID NO: 477 - protein, 58 aa, ARTIFICIAL SEQUENCE
  Engineered IL-17A binding polypeptide
VDAKYAKEMDEAQWEIWLLPNLTWHQGNAFIQKLLDDPSQSSELLSEAKKLNDSQAPK

SEQ ID NO: 478 - protein, 58 aa, ARTIFICIAL SEQUENCE
  Engineered IL-17A binding polypeptide
VDAKYAKEMDEAWWEIWLLPNLTYDQQRAFIVKLLDDPSQSSELLSEAKKLNDSQAPK

SEQ ID NO: 479 - protein, 58 aa, ARTIFICIAL SEQUENCE
  Engineered IL-17A binding polypeptide
VDAKYAKEYDYAWFEIWLLPNLTHAQARAFIHKLNDDPSQSSELLSEAKKLNDSQAPK

SEQ ID NO: 480 - protein, 58 aa, ARTIFICIAL SEQUENCE
  Engineered IL-17A binding polypeptide
VDAKYAKEHAEAWFEIWMLPNLTWAQQRAFIGKLNDDPSQSSELLSEAKKLNDSQAPK

SEQ ID NO: 481 - protein, 58 aa, ARTIFICIAL SEQUENCE
  Engineered IL-17A binding polypeptide
VDAKYAKEMDDAQWEIWLLPNLTWDQSHAFIAKLIDDPSQSSELLSEAKKLNDSQAPK

SEQ ID NO: 482 - protein, 58 aa, ARTIFICIAL SEQUENCE
  Engineered IL-17A binding polypeptide
VDAKYAKEYDEAWFEIWALPNLTHAQAVAFIRKLNDDPSQSSELLSEAKKLNDSQAPK

SEQ ID NO: 483 - protein, 58 aa, ARTIFICIAL SEQUENCE
  Engineered IL-17A binding polypeptide
VDAKYAKEYDFAWFEIWLLPNLTWDQQRAFISKLNDDPSQSSELLSEAKKLNDSQAPK

SEQ ID NO: 484 - protein, 58 aa, ARTIFICIAL SEQUENCE
  Engineered IL-17A binding polypeptide
VDAKYAKEMDEAQWEIWLLPNLTWHQAHAFIRKLIDDPSQSSELLSEAKKLNDSQAPK

SEQ ID NO: 485 - protein, 58 aa, ARTIFICIAL SEQUENCE
  Engineered IL-17A binding polypeptide
VDAKYAKEHDFAWFEIWLLPNLTWDQQVAFIHKLNDDPSQSSELLSEAKKLNDSQAPK

SEQ ID NO: 486 - protein, 58 aa, ARTIFICIAL SEQUENCE
  Engineered IL-17A binding polypeptide
VDAKYAKEWDEAQWEIWLLPNLTWDQSHAFIQKLIDDPSQSSELLSEAKKLNDSQAPK

SEQ ID NO: 487 - protein, 58 aa, ARTIFICIAL SEQUENCE
  Engineered IL-17A binding polypeptide
VDAKYAKEMGRAQIEIWLLPNLTWDQGNAFIRKLIDDPSQSSELLSEAKKLNDSQAPK

SEQ ID NO: 488 - protein, 58 aa, ARTIFICIAL SEQUENCE
  Engineered IL-17A binding polypeptide
VDAKYAKEMDDAQWEIWMLPNLTWHQQHAFIQKLIDDPSQSSELLSEAKKLNDSQAPK

SEQ ID NO: 489 - protein, 58 aa, ARTIFICIAL SEQUENCE
  Engineered IL-17A binding polypeptide
VDAKYAKEADYAWFEIWLLPNLTYDQQYAFIRKLNDDPSQSSELLSEAKKLNDSQAPK

SEQ ID NO: 490 - protein, 58 aa, ARTIFICIAL SEQUENCE
  Engineered IL-17A binding polypeptide
VDAKYAKEADYAWFEIWTLPNLTHDQAKAFIVKLNDDPSQSSELLSEAKKLNDSQAPK

SEQ ID NO: 491 - protein, 58 aa, ARTIFICIAL SEQUENCE
  Engineered IL-17A binding polypeptide
VDAKYAKEMDEAQWEIWLLPNLTWHQSNAFIRKLLDDPSQSSELLSEAKKLNDSQAPK

SEQ ID NO: 492 - protein, 58 aa, ARTIFICIAL SEQUENCE
  Engineered IL-17A binding polypeptide
VDAKYAKEMDYAQWEIWLLPNLTWVQQNAFIRKLIDDPSQSSELLSEAKKLNDSQAPK

SEQ ID NO: 493 - protein, 58 aa, ARTIFICIAL SEQUENCE
  Engineered IL-17A binding polypeptide
VDAKYAKEADYAWWEIWALPNLTHDQAVAFIRKLIDDPSQSSELLSEAKKLNDSQAPK

SEQ ID NO: 494 - protein, 58 aa, ARTIFICIAL SEQUENCE
  Engineered IL-17A binding polypeptide
VDAKYAKEADYAWFEIWALPNLTHRQQVAFIRKLNDDPSQSSELLSEAKKLNDSQAPK

SEQ ID NO: 495 - protein, 58 aa, ARTIFICIAL SEQUENCE
  Engineered IL-17A binding polypeptide
VDAKYAKEMDQAQWEIWLLPNLTWHQQHAFIRKLIDDPSQSSELLSEAKKLNDSQAPK

SEQ ID NO: 496 - protein, 58 aa, ARTIFICIAL SEQUENCE
  Engineered IL-17A binding polypeptide
VDAKYAKEMNEAQLEIWLLPNLTWAQGHAFIQKLIDDPSQSSELLSEAKKLNDSQAPK

SEQ ID NO: 497 - protein, 58 aa, ARTIFICIAL SEQUENCE
  Engineered IL-17A binding polypeptide
VDAKYAKEADEAWWEIWALPNLTHHQAVAFIRKLLDDPSQSSELLSEAKKLNDSQAPK

SEQ ID NO: 498 - protein, 58 aa, ARTIFICIAL SEQUENCE
  Engineered IL-17A binding polypeptide
VDAKYAKEYDYAWFEIWLLPNLTYRQARAFIIKLNDDPSQSSELLSEAKKLNDSQAPK

SEQ ID NO: 499 - protein, 58 aa, ARTIFICIAL SEQUENCE
  Engineered IL-17A binding polypeptide
VDAKYAKEMGEAQWEIWLLPNLTWDQQHAFIQKLIDDPSQSSELLSEAKKLNDSQAPK

SEQ ID NO: 500 - protein, 58 aa, ARTIFICIAL SEQUENCE
  Engineered IL-17A binding polypeptide
VDAKYAKEYDYAWFEIWLLPNLTADQQRAFIHKLNDDPSQSSELLSEAKKLNDSQAPK

SEQ ID NO: 501 - protein, 58 aa, ARTIFICIAL SEQUENCE
  Engineered IL-17A binding polypeptide
VDAKYAKEHDEAWFEIWLLPNLTWDQQVAFIRKLNDDPSQSSELLSEAKKLNDSQAPK

SEQ ID NO: 502 - protein, 58 aa, ARTIFICIAL SEQUENCE
  Engineered IL-17A binding polypeptide
VDAKYAKEYDDAWFEIWLLPNLTWAQQRAFISKLNDDPSQSSELLSEAKKLNDSQAPK

SEQ ID NO: 503 - protein, 58 aa, ARTIFICIAL SEQUENCE
  Engineered IL-17A binding polypeptide
VDAKYAKEYDEAWFEIWLLPNLTRDQGKAFIHKLNDDPSQSSELLSEAKKLNDSQAPK

SEQ ID NO: 504 - protein, 58 aa, ARTIFICIAL SEQUENCE
  Engineered IL-17A binding polypeptide
VDAKYAKEYDDAWFEIWLLPNLTHAQARAFIVKLNDDPSQSSELLSEAKKLNDSQAPK

SEQ ID NO: 505 - protein, 58 aa, ARTIFICIAL SEQUENCE
  Engineered IL-17A binding polypeptide
VDAKYAKEHAEAWFEIWLLPNLTYRQQVAFISKLNDDPSQSSELLSEAKKLNDSQAPK

SEQ ID NO: 506 - protein, 58 aa, ARTIFICIAL SEQUENCE
  Engineered IL-17A binding polypeptide
VDAKYAKEADYAWFEIWMLPNLTRDQAVAFIGKLNDDPSQSSELLSEAKKLNDSQAPK

SEQ ID NO: 507 - protein, 58 aa, ARTIFICIAL SEQUENCE
  Engineered IL-17A binding polypeptide
VDAKYAKEMDEAQWEIWLLPNLTWHQQKAFIQKLIDDPSQSSELLSEAKKLNDSQAPK

SEQ ID NO: 508 - protein, 58 aa, ARTIFICIAL SEQUENCE
  Engineered IL-17A binding polypeptide
VDAKYAKEADYAWFEIWMLPNLTYAQQRAFIVKLLDDPSQSSELLSEAKKLNDSQAPK

SEQ ID NO: 509 - protein, 58 aa, ARTIFICIAL SEQUENCE
  Engineered IL-17A binding polypeptide
VDAKYAKEMDEAQWEIWLLPNLTHAQGRAFIQKLIDDPSQSSELLSEAKKLNDSQAPK

SEQ ID NO: 510 - protein, 58 aa, ARTIFICIAL SEQUENCE
  Engineered IL-17A binding polypeptide
VDAKYAKEMDYAQWEIWLLPNLTWHQSNAFIQKLIDDPSQSSELLSEAKKLNDSQAPK

SEQ ID NO: 511 - protein, 58 aa, ARTIFICIAL SEQUENCE
  Engineered IL-17A binding polypeptide
VDAKYAKEMDEAQWEIWLLPNLTYAQSRAFIVKLIDDPSQSSELLSEAKKLNDSQAPK

SEQ ID NO: 512 - protein, 58 aa, ARTIFICIAL SEQUENCE
  Engineered IL-17A binding polypeptide
VDAKYAKEMDYAQWEIWLLPNLTWDQSRAFIVKLLDDPSQSSELLSEAKKLNDSQAPK

SEQ ID NO: 513 - protein, 58 aa, ARTIFICIAL SEQUENCE
  Engineered IL-17A binding polypeptide
VDAKYAKEMDQAQWEIWLLPNLTYDQGRAFIQKLIDDPSQSSELLSEAKKLNDSQAPK

SEQ ID NO: 514 - protein, 58 aa, ARTIFICIAL SEQUENCE
  Engineered IL-17A binding polypeptide
VDAKYAKEMDYAQWEIWLLPNLTHDQSRAFISKLIDDPSQSSELLSEAKKLNDSQAPK

SEQ ID NO: 515 - protein, 58 aa, ARTIFICIAL SEQUENCE
  Engineered IL-17A binding polypeptide
VDAKYAKEMDEAQWEIWMLPNLTHAQSRAFIQKLIDDPSQSSELLSEAKKLNDSQAPK

SEQ ID NO: 516 - protein, 58 aa, ARTIFICIAL SEQUENCE
  Engineered IL-17A binding polypeptide
VDAKYAKEMDEAWWEIWTLPNLTYDQARAFIVKLIDDPSQSSELLSEAKKLNDSQAPK

SEQ ID NO: 517 - protein, 58 aa, ARTIFICIAL SEQUENCE
  Engineered IL-17A binding polypeptide
VDAKYAKEMDNAQWEIWLLPNLTWDQSRAFIQKLIDDPSQSSELLSEAKKLNDSQAPK

SEQ ID NO: 518 - protein, 58 aa, ARTIFICIAL SEQUENCE
  Engineered IL-17A binding polypeptide
VDAKYAKEADYAWFEIWTLPNLTRDQARAFIHKLNDDPSQSSELLSEAKKLNDSQAPK

SEQ ID NO: 519 - protein, 58 aa, ARTIFICIAL SEQUENCE
  Engineered IL-17A binding polypeptide
VDAKYAKEMDNAQWEIWLLPNLTWDQSRAFIVKLIDDPSQSSELLSEAKKLNDSQAPK

SEQ ID NO: 520 - protein, 58 aa, ARTIFICIAL SEQUENCE
  Engineered IL-17A binding polypeptide
VDAKYAKEADDAAYEIAFLPNLTWDQWYAFIQKLRDDPSQSSELLSEAKKLNDSQAPK

SEQ ID NO: 521 - protein, 58 aa, ARTIFICIAL SEQUENCE
  Engineered IL-17A binding polypeptide
VDAKYAKEADLAAVEIAELPNLTWDQWWAFIQKLRDDPSQSSELLSEAKKLNDSQAPK

SEQ ID NO: 522 - protein, 58 aa, ARTIFICIAL SEQUENCE
  Engineered IL-17A binding polypeptide
VDAKYAKEADDAALEIADLPNLTWEQWYAFISKLRDDPSQSSELLSEAKKLNDSQAPK

SEQ ID NO: 523 - protein, 58 aa, ARTIFICIAL SEQUENCE
  Engineered IL-17A binding polypeptide
VDAKYAKEADQAAYEIAYLPNLTWDQWFAFIEKLRDDPSQSSELLSEAKKLNDSQAPK

SEQ ID NO: 524 - protein, 58 aa, ARTIFICIAL SEQUENCE
  Engineered IL-17A binding polypeptide
VDAKYAKEADQAAVEIADLPNLTWDQWWAFIEKLRDDPSQSSELLSEAKKLNDSQAPK

SEQ ID NO: 525 - protein, 58 aa, ARTIFICIAL SEQUENCE
  Engineered IL-17A binding polypeptide
VDAKYAKEADEAAMEIADLPNLTWDQWWAFISKLRDDPSQSSELLSEAKKLNDSQAPK

SEQ ID NO: 526 - protein, 58 aa, ARTIFICIAL SEQUENCE
  Engineered IL-17A binding polypeptide
VDAKYAKEADMAAFEIALLPNLTWDQWEAFIGKLRDDPSQSSELLSEAKKLNDSQAPK

SEQ ID NO: 527 - protein, 58 aa, ARTIFICIAL SEQUENCE
  Engineered IL-17A binding polypeptide
VDAKYAKEADDAAVEIADLPNLTWDQWWAFIRKLRDDPSQSSELLSEAKKLNDSQAPK

SEQ ID NO: 528 - protein, 58 aa, ARTIFICIAL SEQUENCE
  Engineered IL-17A binding polypeptide
VDAKYAKEADDAAVEIAELPNLTWEQWYAFIDKLRDDPSQSSELLSEAKKLNDSQAPK

SEQ ID NO: 529 - protein, 58 aa, ARTIFICIAL SEQUENCE
  Engineered IL-17A binding polypeptide
VDAKYAKEADEAAVEIAALPNLTWDQWFAFIDKLRDDPSQSSELLSEAKKLNDSQAPK

SEQ ID NO: 530 - protein, 58 aa, ARTIFICIAL SEQUENCE
  Engineered IL-17A binding polypeptide
VDAKYAKEADEAAYEIAFLPNLTWDQWYAFITKLRDDPSQSSELLSEAKKLNDSQAPK

SEQ ID NO: 531 - protein, 58 aa, ARTIFICIAL SEQUENCE
  Engineered IL-17A binding polypeptide
VDAKYAKEADNAALEIADLPNLTWDQWYAFIAKLRDDPSQSSELLSEAKKLNDSQAPK

SEQ ID NO: 532 - protein, 58 aa, ARTIFICIAL SEQUENCE
  Engineered IL-17A binding polypeptide
VDAKYAKEADDAAVEIANLPNLTWDQWWAFITKLRDDPSQSSELLSEAKKLNDSQAPK

SEQ ID NO: 533 - protein, 58 aa, ARTIFICIAL SEQUENCE
  Engineered IL-17A binding polypeptide
VDAKYAKEADEAAYEIAFLPNLTWDQWFAFINKLRDDPSQSSELLSEAKKLNDSQAPK

SEQ ID NO: 534 - protein, 58 aa, ARTIFICIAL SEQUENCE
  Engineered IL-17A binding polypeptide
VDAKYAKEADDAALEIADLPNLTWDQWIAFINKLRDDPSQSSELLSEAKKLNDSQAPK

SEQ ID NO: 535 - protein, 58 aa, ARTIFICIAL SEQUENCE
  Engineered IL-17A binding polypeptide
VDAKYAKEADNAAMEIADLPNLTWDQWFAFINKLRDDPSQSSELLSEAKKLNDSQAPK

SEQ ID NO: 536 - protein, 58 aa, ARTIFICIAL SEQUENCE
  Engineered IL-17A binding polypeptide
VDAKYAKEADDAAFEIAFLPNLTWDQWWAFINKLRDDPSQSSELLSEAKKLNDSQAPK

SEQ ID NO: 537 - protein, 58 aa, ARTIFICIAL SEQUENCE
  Engineered IL-17A binding polypeptide
VDAKYAKEADDAAMEIAELPNLTWDQWYAFINKLRDDPSQSSELLSEAKKLNDSQAPK

SEQ ID NO: 538 - protein, 58 aa, ARTIFICIAL SEQUENCE
  Engineered IL-17A binding polypeptide
VDAKYAKEADDAAVEIAYLPNLTWDQWFAFIDKLRDDPSQSSELLSEAKKLNDSQAPK

SEQ ID NO: 539 - protein, 58 aa, ARTIFICIAL SEQUENCE
  Engineered IL-17A binding polypeptide
VDAKYAKEADSAAVEIADLPNLTWDQWYAFINKLRDDPSQSSELLSEAKKLNDSQAPK

SEQ ID NO: 540 - protein, 58 aa, ARTIFICIAL SEQUENCE
  Engineered IL-17A binding polypeptide
VDAKYAKEADEAAYEIAFLPNLTWDQWAAFIEKLRDDPSQSSELLSEAKKLNDSQAPK

SEQ ID NO: 541 - protein, 58 aa, ARTIFICIAL SEQUENCE
  Engineered IL-17A binding polypeptide
VDAKYAKEADMAAMEIADLPNLTWDQWWAFIWKLRDDPSQSSELLSEAKKLNDSQAPK

SEQ ID NO: 542 - protein, 58 aa, ARTIFICIAL SEQUENCE
  Engineered IL-17A binding polypeptide
VDAKYAKEADDAAVEIADLPNLTWDQWWAFIQKLRDDPSQSSELLSEAKKLNDSQAPK

SEQ ID NO: 543 - protein, 58 aa, ARTIFICIAL SEQUENCE
  Engineered IL-17A binding polypeptide
VDAKYAKEADEAAMEIADLPNLTWDQWEAFILKLRDDPSQSSELLSEAKKLNDSQAPK

SEQ ID NO: 544 - protein, 58 aa, ARTIFICIAL SEQUENCE
  Engineered IL-17A binding polypeptide
VDAKYAKEADEAAVEIADLPNLTWDQWYAFITKLRDDPSQSSELLSEAKKLNDSQAPK

SEQ ID NO: 545 - protein, 58 aa, ARTIFICIAL SEQUENCE
  Engineered IL-17A binding polypeptide
VDAKYAKEADEAAYEIASLPNLTWDQWFAFIEKLRDDPSQSSELLSEAKKLNDSQAPK

SEQ ID NO: 546 - protein, 58 aa, ARTIFICIAL SEQUENCE
  Engineered IL-17A binding polypeptide
VDAKYAKEADDAAVEIANLPNLTWDQWFAFIDKLRDDPSQSSELLSEAKKLNDSQAPK

SEQ ID NO: 547 - protein, 58 aa, ARTIFICIAL SEQUENCE
  Engineered IL-17A binding polypeptide
VDAKYAKEADDAAYEIAYLPNLTWDQWFAFIQKLRDDPSQSSELLSEAKKLNDSQAPK

SEQ ID NO: 548 - protein, 58 aa, ARTIFICIAL SEQUENCE
  Engineered IL-17A binding polypeptide
VDAKYAKEADDAAVEIAALPNLTWDQWYAFIEKLRDDPSQSSELLSEAKKLNDSQAPK

SEQ ID NO: 549 - protein, 58 aa, ARTIFICIAL SEQUENCE
  Engineered IL-17A binding polypeptide
VDAKYAKEADNAAMEIAELPNLTWDQWYAFINKLRDDPSQSSELLSEAKKLNDSQAPK

SEQ ID NO: 550 - protein, 58 aa, ARTIFICIAL SEQUENCE
  Engineered IL-17A binding polypeptide
VDAKYAKEADEAAYEIAYLPNLTWDQWWAFIQKLRDDPSQSSELLSEAKKLNDSQAPK

SEQ ID NO: 551 - protein, 58 aa, ARTIFICIAL SEQUENCE
  Engineered IL-17A binding polypeptide
VDAKYAKEADDAAFEIALLPNLTWDQWHAFIGKLRDDPSQSSELLSEAKKLNDSQAPK

SEQ ID NO: 552 - protein, 58 aa, ARTIFICIAL SEQUENCE
  Engineered IL-17A binding polypeptide
VDAKYAKEADMAAVEIAGLPNLTWDQWYAFIGKLRDDPSQSSELLSEAKKLNDSQAPK

SEQ ID NO: 553 - protein, 58 aa, ARTIFICIAL SEQUENCE
  Engineered IL-17A binding polypeptide
VDAKYAKEADMAAVEIAELPNLTWDQWWAFIGKLRDDPSQSSELLSEAKKLNDSQAPK

SEQ ID NO: 554 - protein, 58 aa, ARTIFICIAL SEQUENCE
  Engineered IL-17A binding polypeptide
VDAKYAKEADDAAVEIAGLPNLTWDQWFAFIDKLRDDPSQSSELLSEAKKLNDSQAPK

SEQ ID NO: 555 - protein, 58 aa, ARTIFICIAL SEQUENCE
  Engineered IL-17A binding polypeptide
VDAKYAKEADAAAVEIADLPNLTWDQWWAFIQKLRDDPSQSSELLSEAKKLNDSQAPK

SEQ ID NO: 556 - protein, 58 aa, ARTIFICIAL SEQUENCE
  Engineered IL-17A binding polypeptide
VDAKYAKEADDAAVEIADLPNLTWDQWYAFIDKLRDDPSQSSELLSEAKKLNDSQAPK

SEQ ID NO: 557 - protein, 58 aa, ARTIFICIAL SEQUENCE
  Engineered IL-17A binding polypeptide
VDAKYAKEADDAAVEIAELPNLTWEQWFAFIGKLRDDPSQSSELLSEAKKLNDSQAPK

SEQ ID NO: 558 - protein, 58 aa, ARTIFICIAL SEQUENCE
  Engineered IL-17A binding polypeptide
VDAKYAKEADDAAVEIAELPNLTWEQWAAFISKLRDDPSQSSELLSEAKKLNDSQAPK

SEQ ID NO: 559 - protein, 58 aa, ARTIFICIAL SEQUENCE
  Engineered IL-17A binding polypeptide
VDAKYAKEADDAAIEIADLPNLTWDQWWAFINKLRDDPSQSSELLSEAKKLNDSQAPK

SEQ ID NO: 560 - protein, 58 aa, ARTIFICIAL SEQUENCE
  Engineered IL-17A binding polypeptide
VDAKYAKEADDAAFEIAMLPNLTWDQWEAFILKLRDDPSQSSELLSEAKKLNDSQAPK

SEQ ID NO: 561 - protein, 58 aa, ARTIFICIAL SEQUENCE
  Engineered IL-17A binding polypeptide
VDAKYAKEADDAAMEIADLPNLTWDQWEAFILKLRDDPSQSSELLSEAKKLNDSQAPK

SEQ ID NO: 562 - protein, 58 aa, ARTIFICIAL SEQUENCE
  Engineered IL-17A binding polypeptide
VDAKYAKEADEAAVEIAELPNLTWDQWAAFIDKLRDDPSQSSELLSEAKKLNDSQAPK

SEQ ID NO: 563 - protein, 58 aa, ARTIFICIAL SEQUENCE
  Engineered IL-17A binding polypeptide
VDAKYAKEADDAAFEIAELPNLTWDQWFAFINKLRDDPSQSSELLSEAKKLNDSQAPK

SEQ ID NO: 564 - protein, 58 aa, ARTIFICIAL SEQUENCE
  Engineered IL-17A binding polypeptide
VDAKYAKEADDAAVEIASLPNLTWDQWEAFILKLRDDPSQSSELLSEAKKLNDSQAPK

SEQ ID NO: 565 - protein, 58 aa, ARTIFICIAL SEQUENCE
  Engineered IL-17A binding polypeptide
VDAKYAKEADAAAYEIADLPNLTWDQWYAFIEKLRDDPSQSSELLSEAKKLNDSQAPK

SEQ ID NO: 566 - protein, 58 aa, ARTIFICIAL SEQUENCE
  Engineered IL-17A binding polypeptide
VDAKYAKEADEAAVEIAALPNLTWDQWWAFIMKLRDDPSQSSELLSEAKKLNDSQAPK

SEQ ID NO: 567 - protein, 58 aa, ARTIFICIAL SEQUENCE
  Engineered IL-17A binding polypeptide
VDAKYAKEADEAAVEIAFLPNLTWDQWFAFIDKLRDDPSQSSELLSEAKKLNDSQAPK

SEQ ID NO: 568 - protein, 58 aa, ARTIFICIAL SEQUENCE
  Engineered IL-17A binding polypeptide
VDAKYAKEADAAAYEIAFLPNLTWDQWFAFIEKLRDDPSQSSELLSEAKKLNDSQAPK

SEQ ID NO: 569 - protein, 58 aa, ARTIFICIAL SEQUENCE
  Engineered IL-17A binding polypeptide
VDAKYAKEADRAAFEIAELPNLTWDQWWAFIRKLRDDPSQSSELLSEAKKLNDSQAPK

SEQ ID NO: 570 - protein, 58 aa, ARTIFICIAL SEQUENCE
  Engineered IL-17A binding polypeptide
VDAKYAKEADDAAVEIAELPNLTWDQWMAFIHKLRDDPSQSSELLSEAKKLNDSQAPK

SEQ ID NO: 571 - protein, 58 aa, ARTIFICIAL SEQUENCE
  Engineered IL-17A binding polypeptide
VDAKYAKEADDAAVEIAYLPNLTWDQWFAFITKLRDDPSQSSELLSEAKKLNDSQAPK

SEQ ID NO: 572 - protein, 58 aa, ARTIFICIAL SEQUENCE
  Engineered IL-17A binding polypeptide
VDAKYAKEADDAAMEIADLPNLTWDQWYAFISKLRDDPSQSSELLSEAKKLNDSQAPK

SEQ ID NO: 573 - protein, 58 aa, ARTIFICIAL SEQUENCE
  Engineered IL-17A binding polypeptide
VDAKYAKEADDAAYEIAFLPNLTWEQWWAFISKLRDDPSQSSELLSEAKKLNDSQAPK

SEQ ID NO: 574 - protein, 58 aa, ARTIFICIAL SEQUENCE
  Engineered IL-17A binding polypeptide
VDAKYAKEADMAAYEIASLPNLTWDQWFAFISKLRDDPSQSSELLSEAKKLNDSQAPK

SEQ ID NO: 575 - protein, 58 aa, ARTIFICIAL SEQUENCE
  Engineered IL-17A binding polypeptide
VDAKYAKEADDAAFEIANLPNLTWDQWFAFINKLRDDPSQSSELLSEAKKLNDSQAPK

SEQ ID NO: 576 - protein, 58 aa, ARTIFICIAL SEQUENCE
  Engineered IL-17A binding polypeptide
VDAKYAKEADSAAMEIADLPNLTWDQWMAFIQKLRDDPSQSSELLSEAKKLNDSQAPK

SEQ ID NO: 577 - protein, 58 aa, ARTIFICIAL SEQUENCE
  Engineered IL-17A binding polypeptide
VDAKYAKEADMAAVEIASLPNLTWDQWHAFIMKLRDDPSQSSELLSEAKKLNDSQAPK

SEQ ID NO: 578 - protein, 58 aa, ARTIFICIAL SEQUENCE
  Engineered IL-17A binding polypeptide
VDAKYAKEADAAAVEIADLPNLTWDQWHAFITKLRDDPSQSSELLSEAKKLNDSQAPK

SEQ ID NO: 579 - protein, 58 aa, ARTIFICIAL SEQUENCE
  Engineered IL-17A binding polypeptide
VDAKYAKEADDAAVEIANLPNLTWAQWEAFIMKLRDDPSQSSELLSEAKKLNDSQAPK

SEQ ID NO: 580 - protein, 58 aa, ARTIFICIAL SEQUENCE
  Engineered IL-17A binding polypeptide
VDAKYAKEADIAAMEIADLPNLTWDQWWAFINKLRDDPSQSSELLSEAKKLNDSQAPK

SEQ ID NO: 581 - protein, 58 aa, ARTIFICIAL SEQUENCE
  Engineered IL-17A binding polypeptide
VDAKYAKEADHAAVEIAGLPNLTWDQWFAFINKLRDDPSQSSELLSEAKKLNDSQAPK

SEQ ID NO: 582 - protein, 58 aa, ARTIFICIAL SEQUENCE
  Engineered IL-17A binding polypeptide
VDAKYAKEADEAAYEIAELPNLTWDQWWAFIGKLRDDPSQSSELLSEAKKLNDSQAPK

SEQ ID NO: 583 - protein, 58 aa, ARTIFICIAL SEQUENCE
  Engineered IL-17A binding polypeptide
VDAKYAKEADEAAFEIAELPNLTWDQWFAFIGKLRDDPSQSSELLSEAKKLNDSQAPK

SEQ ID NO: 584 - protein, 58 aa, ARTIFICIAL SEQUENCE
  Engineered IL-17A binding polypeptide
VDAKYAKEADAAAVEIANLPNLTWDQWWAFIEKLRDDPSQSSELLSEAKKLNDSQAPK

SEQ ID NO: 585 - protein, 58 aa, ARTIFICIAL SEQUENCE
  Engineered IL-17A binding polypeptide
VDAKYAKEADDAAMEIAALPNLTWFQWWAFINKLRDDPSQSSELLSEAKKLNDSQAPK

SEQ ID NO: 586 - protein, 58 aa, ARTIFICIAL SEQUENCE
  Engineered IL-17A binding polypeptide
VDAKYAKEADDAAVEIAELPNLTWDQWFAFIGKLRDDPSQSSELLSEAKKLNDSQAPK

SEQ ID NO: 587 - protein, 58 aa, ARTIFICIAL SEQUENCE
  Engineered IL-17A binding polypeptide
VDAKYAKEADEAAFEIASLPNLTWEQWLAFIAKLRDDPSQSSELLSEAKKLNDSQAPK

SEQ ID NO: 588 - protein, 58 aa, ARTIFICIAL SEQUENCE
  Engineered IL-17A binding polypeptide
VDAKYAKEADDAAIEIAYLPNLTWDQWWAFITKLRDDPSQSSELLSEAKKLNDSQAPK

SEQ ID NO: 589 - protein, 58 aa, ARTIFICIAL SEQUENCE
  Engineered IL-17A binding polypeptide
VDAKYAKEADDAAVEIAFLPNLTWDQWYAFIDKLRDDPSQSSELLSEAKKLNDSQAPK

SEQ ID NO: 590 - protein, 58 aa, ARTIFICIAL SEQUENCE
  Engineered IL-17A binding polypeptide
VDAKYAKEADDAAYEIAQLPNLTWDQWAAFIQKLRDDPSQSSELLSEAKKLNDSQAPK

SEQ ID NO: 591 - protein, 58 aa, ARTIFICIAL SEQUENCE
  Engineered IL-17A binding polypeptide
VDAKYAKEADDAAVEIALLPNLTWDQWFAFIDKLRDDPSQSSELLSEAKKLNDSQAPK

SEQ ID NO: 592 - protein, 58 aa, ARTIFICIAL SEQUENCE
  Engineered IL-17A binding polypeptide
VDAKYAKEADEAAYEIAYLPNLTWEQWWAFIEKLRDDPSQSSELLSEAKKLNDSQAPK

SEQ ID NO: 593 - protein, 58 aa, ARTIFICIAL SEQUENCE
  Engineered IL-17A binding polypeptide
VDAKYAKEADEAAVEIALLPNLTWDQWFAFITKLRDDPSQSSELLSEAKKLNDSQAPK

SEQ ID NO: 594 - protein, 58 aa, ARTIFICIAL SEQUENCE
  Engineered IL-17A binding polypeptide
VDAKYAKEADAAAYEIADLPNLTWDQWMAFIEKLRDDPSQSSELLSEAKKLNDSQAPK

SEQ ID NO: 595 - protein, 58 aa, ARTIFICIAL SEQUENCE
  Engineered IL-17A binding polypeptide
VDAKYAKEADDAAYEIAFLPNLTWDQWEAFIDKLRDDPSQSSELLSEAKKLNDSQAPK

SEQ ID NO: 596 - protein, 58 aa, ARTIFICIAL SEQUENCE
  Engineered IL-17A binding polypeptide
VDAKYAKEADDAAMEIAELPNLTWDQWAAFIDKLRDDPSQSSELLSEAKKLNDSQAPK

SEQ ID NO: 597 - protein, 58 aa, ARTIFICIAL SEQUENCE
  Engineered IL-17A binding polypeptide
VDAKYAKEADNAAMEIAGLPNLTWDQWFAFIDKLRDDPSQSSELLSEAKKLNDSQAPK

SEQ ID NO: 598 - protein, 58 aa, ARTIFICIAL SEQUENCE
  Engineered IL-17A binding polypeptide
VDAKYAKEADDAAYEIAELPNLTWLQWEAFIAKLRDDPSQSSELLSEAKKLNDSQAPK

SEQ ID NO: 599 - protein, 58 aa, ARTIFICIAL SEQUENCE
  Engineered IL-17A binding polypeptide
VDAKYAKEADEAAYEIAMLPNLTWDQWWAFITKLRDDPSQSSELLSEAKKLNDSQAPK

SEQ ID NO: 600 - protein, 58 aa, ARTIFICIAL SEQUENCE
  Engineered IL-17A binding polypeptide
VDAKYAKEADEAAYEIAELPNLTWDQWWAFIQKLRDDPSQSSELLSEAKKLNDSQAPK

SEQ ID NO: 601 - protein, 58 aa, ARTIFICIAL SEQUENCE
  Engineered IL-17A binding polypeptide
VDAKYAKEADDAAYEIASLPNLTWDQWQAFIDKLRDDPSQSSELLSEAKKLNDSQAPK

SEQ ID NO: 602 - protein, 58 aa, ARTIFICIAL SEQUENCE
  Engineered IL-17A binding polypeptide
VDAKYAKEADDAAYEIAFLPNLTWDQWFAFITKLRDDPSQSSELLSEAKKLNDSQAPK

SEQ ID NO: 603 - protein, 58 aa, ARTIFICIAL SEQUENCE
  Engineered IL-17A binding polypeptide
VDAKYAKEADMAAFEIASLPNLTWAQWAAFIEKLRDDPSQSSELLSEAKKLNDSQAPK

SEQ ID NO: 604 - protein, 58 aa, ARTIFICIAL SEQUENCE
  Engineered IL-17A binding polypeptide
VDAKYAKEADNAAYEIAELPNLTWDQWYAFIMKLRDDPSQSSELLSEAKKLNDSQAPK

SEQ ID NO: 605 - protein, 58 aa, ARTIFICIAL SEQUENCE
  Engineered IL-17A binding polypeptide
VDAKYAKEADDAAVEIASLPNLTWVQWDAFIQKLRDDPSQSSELLSEAKKLNDSQAPK

SEQ ID NO: 606 - protein, 58 aa, ARTIFICIAL SEQUENCE
  Engineered IL-17A binding polypeptide
VDAKYAKEADDAAVEIAYLPNLTWDQWYAFISKLRDDPSQSSELLSEAKKLNDSQAPK

SEQ ID NO: 607 - protein, 58 aa, ARTIFICIAL SEQUENCE
  Engineered IL-17A binding polypeptide
VDAKYAKEADDAAFEIALLPNLTWDQWDAFISKLRDDPSQSSELLSEAKKLNDSQAPK

SEQ ID NO: 608 - protein, 58 aa, ARTIFICIAL SEQUENCE
  Engineered IL-17A binding polypeptide
VDAKYAKEADDAAVEIADLPNLTWDQWWAFIHKLRDDPSQSSELLSEAKKLNDSQAPK

SEQ ID NO: 609 - protein, 58 aa, ARTIFICIAL SEQUENCE
  Engineered IL-17A binding polypeptide
VDAKYAKEADDAAVEIADLPNLTWDQWEAFIAKLRDDPSQSSELLSEAKKLNDSQAPK

SEQ ID NO: 610 - protein, 58 aa, ARTIFICIAL SEQUENCE
  Engineered IL-17A binding polypeptide
VDAKYAKEADMAAIEIADLPNLTWDQWWAFITKLRDDPSQSSELLSEAKKLNDSQAPK

SEQ ID NO: 611 - protein, 58 aa, ARTIFICIAL SEQUENCE
  Engineered IL-17A binding polypeptide
VDAKYAKEADDAAVEIADLPNLTWDQWWAFIGKLRDDPSQSSELLSEAKKLNDSQAPK

SEQ ID NO: 612 - protein, 58 aa, ARTIFICIAL SEQUENCE
  Engineered IL-17A binding polypeptide
VDAKYAKEADDAAFEIAALPNLTWDQWYAFINKLRDDPSQSSELLSEAKKLNDSQAPK

SEQ ID NO: 613 - protein, 58 aa, ARTIFICIAL SEQUENCE
  Engineered IL-17A binding polypeptide
VDAKYAKEADDAAFEIASLPNLTWDQWYAFINKLRDDPSQSSELLSEAKKLNDSQAPK

SEQ ID NO: 614 - protein, 58 aa, ARTIFICIAL SEQUENCE
  Engineered IL-17A binding polypeptide
VDAKYAKEADAAAAEIADLPNLTWDQWWAFIHKLRDDPSQSSELLSEAKKLNDSQAPK

SEQ ID NO: 615 - protein, 58 aa, ARTIFICIAL SEQUENCE
  Engineered IL-17A binding polypeptide
VDAKYAKEADDAAYEIAFLPNLTWDQWWAFITKLRDDPSQSSELLSEAKKLNDSQAPK

SEQ ID NO: 616 - protein, 58 aa, ARTIFICIAL SEQUENCE
  Engineered IL-17A binding polypeptide
VDAKYAKEADDAAVEIANLPNLTWDQWFAFIQKLRDDPSQSSELLSEAKKLNDSQAPK

SEQ ID NO: 617 - protein, 58 aa, ARTIFICIAL SEQUENCE
  Engineered IL-17A binding polypeptide
VDAKYAKEADDAAVEIAALPNLTWDQWDAFIRKLRDDPSQSSELLSEAKKLNDSQAPK

SEQ ID NO: 618 - protein, 58 aa, ARTIFICIAL SEQUENCE
  Engineered IL-17A binding polypeptide
VDAKYAKEADIAAMEIAELPNLTWDQWWAFIGKLRDDPSQSSELLSEAKKLNDSQAPK

SEQ ID NO: 619 - protein, 58 aa, ARTIFICIAL SEQUENCE
  Engineered IL-17A binding polypeptide
VDAKYAKEADDAAMEIAILPNLTWDQWEAFIWKLRDDPSQSSELLSEAKKLNDSQAPK

SEQ ID NO: 620 - protein, 58 aa, ARTIFICIAL SEQUENCE
  Engineered IL-17A binding polypeptide
VDAKYAKEADSAAVEIADLPNLTWDQWYAFITKLRDDPSQSSELLSEAKKLNDSQAPK

SEQ ID NO: 621 - protein, 58 aa, ARTIFICIAL SEQUENCE
  Engineered IL-17A binding polypeptide
VDAKYAKEADEAAVEIADLPNLTWDQWFAFINKLRDDPSQSSELLSEAKKLNDSQAPK

SEQ ID NO: 622 - protein, 58 aa, ARTIFICIAL SEQUENCE
  Engineered IL-17A binding polypeptide
VDAKYAKEADAAAYEIAYLPNLTWDQWYAFISKLRDDPSQSSELLSEAKKLNDSQAPK

SEQ ID NO: 623 - protein, 58 aa, ARTIFICIAL SEQUENCE
  Engineered IL-17A binding polypeptide
VDAKYAKEADDAAYEIAALPNLTWDQWYAFITKLRDDPSQSSELLSEAKKLNDSQAPK

SEQ ID NO: 624 - protein, 58 aa, ARTIFICIAL SEQUENCE
  Engineered IL-17A binding polypeptide
VDAKYAKEADIAAVEIAELPNLTWDQWWAFIEKLRDDPSQSSELLSEAKKLNDSQAPK

SEQ ID NO: 625 - protein, 58 aa, ARTIFICIAL SEQUENCE
  Engineered IL-17A binding polypeptide
VDAKYAKEADRAAMEIAELPNLTWIQWEAFILKLRDDPSQSSELLSEAKKLNDSQAPK

SEQ ID NO: 626 - protein, 58 aa, ARTIFICIAL SEQUENCE
  Engineered IL-17A binding polypeptide
VDAKYAKEADDAAVEIANLPNLTWDQWEAFILKLRDDPSQSSELLSEAKKLNDSQAPK

SEQ ID NO: 627 - protein, 58 aa, ARTIFICIAL SEQUENCE
  Engineered IL-17A binding polypeptide
VDAKYAKEADEAAMEIAELPNLTWDQWWAFIDKLRDDPSQSSELLSEAKKLNDSQAPK

SEQ ID NO: 628 - protein, 58 aa, ARTIFICIAL SEQUENCE
  Engineered IL-17A binding polypeptide
VDAKYAKEADEAAVEIANLPNLTWDQWEAFILKLRDDPSQSSELLSEAKKLNDSQAPK

SEQ ID NO: 629 - protein, 58 aa, ARTIFICIAL SEQUENCE
  Engineered IL-17A binding polypeptide
VDAKYAKEADDAAMEIADLPNLTWDQWIAFIDKLRDDPSQSSELLSEAKKLNDSQAPK

SEQ ID NO: 630 - protein, 58 aa, ARTIFICIAL SEQUENCE
  Engineered IL-17A binding polypeptide
VDAKYAKEADDAAYEIAFLPNLTWDQWYAFINKLRDDPSQSSELLSEAKKLNDSQAPK

SEQ ID NO: 631 - protein, 58 aa, ARTIFICIAL SEQUENCE
  Engineered IL-17A binding polypeptide
VDAKYAKEADDAAVEIADLPNLTWEQWWAFINKLRDDPSQSSELLSEAKKLNDSQAPK

SEQ ID NO: 632 - protein, 58 aa, ARTIFICIAL SEQUENCE
  Engineered IL-17A binding polypeptide
VDAKYAKEADAAAVEIAELPNLTWDQWWAFIEKLRDDPSQSSELLSEAKKLNDSQAPK

SEQ ID NO: 633 - protein, 58 aa, ARTIFICIAL SEQUENCE
  Engineered IL-17A binding polypeptide
VDAKYAKEADEAAVEIAFLPNLTWDQWWAFINKLRDDPSQSSELLSEAKKLNDSQAPK

SEQ ID NO: 634 - protein, 58 aa, ARTIFICIAL SEQUENCE
  Engineered IL-17A binding polypeptide
VDAKYAKEADDAAYEIAELPNLTWDQWWAFINKLRDDPSQSSELLSEAKKLNDSQAPK

SEQ ID NO: 635 - protein, 58 aa, ARTIFICIAL SEQUENCE
  Engineered IL-17A binding polypeptide
VDAKYAKEADAAAYEIAGLPNLTWDQWFAFINKLRDDPSQSSELLSEAKKLNDSQAPK

SEQ ID NO: 636 - protein, 58 aa, ARTIFICIAL SEQUENCE
  Engineered IL-17A binding polypeptide
VDAKYAKEADDAAYEIAFLPNLTWDQWDAFIGKLRDDPSQSSELLSEAKKLNDSQAPK

SEQ ID NO: 637 - protein, 58 aa, ARTIFICIAL SEQUENCE
  Engineered IL-17A binding polypeptide
VDAKYAKEADDAAVEIAQLPNLTWDQWFAFINKLRDDPSQSSELLSEAKKLNDSQAPK

SEQ ID NO: 638 - protein, 58 aa, ARTIFICIAL SEQUENCE
  Engineered IL-17A binding polypeptide
VDAKYAKEADQAAYEIAFLPNLTWDQWEAFIFKLRDDPSQSSELLSEAKKLNDSQAPK

SEQ ID NO: 639 - protein, 58 aa, ARTIFICIAL SEQUENCE
  Engineered IL-17A binding polypeptide
VDAKYAKEADSAAVEIADLPNLTWAQWDAFISKLRDDPSQSSELLSEAKKLNDSQAPK

SEQ ID NO: 640 - protein, 58 aa, ARTIFICIAL SEQUENCE
  Engineered IL-17A binding polypeptide
VDAKYAKEADAAAMEIANLPNLTWDQWEAFIQKLRDDPSQSSELLSEAKKLNDSQAPK

SEQ ID NO: 641 - protein, 58 aa, ARTIFICIAL SEQUENCE
  Engineered IL-17A binding polypeptide
VDAKYAKEADGAALEIAELPNLTWDQWEAFIQKLRDDPSQSSELLSEAKKLNDSQAPK

SEQ ID NO: 642 - protein, 58 aa, ARTIFICIAL SEQUENCE
  Engineered IL-17A binding polypeptide
VDAKYAKEADEAAVEIADLPNLTWDQWYAFISKLRDDPSQSSELLSEAKKLNDSQAPK

SEQ ID NO: 643 - protein, 58 aa, ARTIFICIAL SEQUENCE
  Engineered IL-17A binding polypeptide
VDAKYAKEADDAAYEIAELPNLTWDQWFAFIHKLRDDPSQSSELLSEAKKLNDSQAPK

SEQ ID NO: 644 - protein, 58 aa, ARTIFICIAL SEQUENCE
  Engineered IL-17A binding polypeptide
VDAKYAKEADDAAFEIAALPNLTWEQWMAFIEKLRDDPSQSSELLSEAKKLNDSQAPK

SEQ ID NO: 645 - protein, 58 aa, ARTIFICIAL SEQUENCE
  Engineered IL-17A binding polypeptide
VDAKYAKEADDAAYEIAYLPNLTWDQWYAFIGKLRDDPSQSSELLSEAKKLNDSQAPK

SEQ ID NO: 646 - protein, 58 aa, ARTIFICIAL SEQUENCE
  Engineered IL-17A binding polypeptide
VDAKYAKEADQAAMEIADLPNLTWDQWAAFIMKLRDDPSQSSELLSEAKKLNDSQAPK

SEQ ID NO: 647 - protein, 58 aa, ARTIFICIAL SEQUENCE
  Engineered IL-17A binding polypeptide
VDAKYAKEADDAAYEIAYLPNLTWDQWWAFINKLRDDPSQSSELLSEAKKLNDSQAPK

SEQ ID NO: 648 - protein, 58 aa, ARTIFICIAL SEQUENCE
  Engineered IL-17A binding polypeptide
VDAKYAKEADDAAMEIASLPNLTWDQWWAFIAKLRDDPSQSSELLSEAKKLNDSQAPK

SEQ ID NO: 649 - protein, 58 aa, ARTIFICIAL SEQUENCE
  Engineered IL-17A binding polypeptide
VDAKYAKEADEAAVEIADLPNLTWEQWAAFINKLRDDPSQSSELLSEAKKLNDSQAPK

SEQ ID NO: 650 - protein, 58 aa, ARTIFICIAL SEQUENCE
  Engineered IL-17A binding polypeptide
VDAKYAKEADDAAVEIADLPNLTWDQWWAFINKLRDDPSQSSELLSEAKKLNDSQAPK

SEQ ID NO: 651 - protein, 58 aa, ARTIFICIAL SEQUENCE
  Engineered IL-17A binding polypeptide
VDAKYAKEADAAAVEIAELPNLTWDQWDAFITKLRDDPSQSSELLSEAKKLNDSQAPK

SEQ ID NO: 652 - protein, 58 aa, ARTIFICIAL SEQUENCE
  Engineered IL-17A binding polypeptide
VDAKYAKEADNAAMEIADLPNLTWDQWMAFIEKLRDDPSQSSELLSEAKKLNDSQAPK

SEQ ID NO: 653 - protein, 58 aa, ARTIFICIAL SEQUENCE
  Engineered IL-17A binding polypeptide
VDAKYAKEADHAAMEIAELPNLTWDQWWAFIDKLRDDPSQSSELLSEAKKLNDSQAPK

SEQ ID NO: 654 - protein, 58 aa, ARTIFICIAL SEQUENCE
  Engineered IL-17A binding polypeptide
VDAKYAKEADAAAYEIAALPNLTWDQWWAFITKLRDDPSQSSELLSEAKKLNDSQAPK

SEQ ID NO: 655 - protein, 58 aa, ARTIFICIAL SEQUENCE
  Engineered IL-17A binding polypeptide
VDAKYAKEADEAAFEIALLPNLTWDQWLAFIDKLRDDPSQSSELLSEAKKLNDSQAPK

SEQ ID NO: 656 - protein, 58 aa, ARTIFICIAL SEQUENCE
  Engineered IL-17A binding polypeptide
VDAKYAKEADDAALEIADLPNLTWDQWFAFIDKLRDDPSQSSELLSEAKKLNDSQAPK

SEQ ID NO: 657 - protein, 58 aa, ARTIFICIAL SEQUENCE
  Engineered IL-17A binding polypeptide
VDAKYAKEADKAAMEIADLPNLTWDQWEAFILKLRDDPSQSSELLSEAKKLNDSQAPK

SEQ ID NO: 658 - protein, 58 aa, ARTIFICIAL SEQUENCE
  Engineered IL-17A binding polypeptide
VDAKYAKEADDAAMEIADLPNLTWDQWWAFITKLRDDPSQSSELLSEAKKLNDSQAPK

SEQ ID NO: 659 - protein, 58 aa, ARTIFICIAL SEQUENCE
  Engineered IL-17A binding polypeptide
VDAKYAKEADNAAVEIAELPNLTWDQWFAFIGKLRDDPSQSSELLSEAKKLNDSQAPK

SEQ ID NO: 660 - protein, 58 aa, ARTIFICIAL SEQUENCE
  Engineered IL-17A binding polypeptide
VDAKYAKEADDAAIEIAELPNLTWDQWAAFIWKLRDDPSQSSELLSEAKKLNDSQAPK

SEQ ID NO: 661 - protein, 58 aa, ARTIFICIAL SEQUENCE
  Engineered IL-17A binding polypeptide
VDAKYAKEADQAAYEIAELPNLTWDQWFAFIGKLRDDPSQSSELLSEAKKLNDSQAPK

SEQ ID NO: 662 - protein, 58 aa, ARTIFICIAL SEQUENCE
  Engineered IL-17A binding polypeptide
VDAKYAKEADQAAVEIAGLPNLTWDQWWAFIDKLRDDPSQSSELLSEAKKLNDSQAPK

SEQ ID NO: 663 - protein, 58 aa, ARTIFICIAL SEQUENCE
  Engineered IL-17A binding polypeptide
VDAKYAKEADTAAYEIAMLPNLTWEQWWAFITKLRDDPSQSSELLSEAKKLNDSQAPK

SEQ ID NO: 664 - protein, 58 aa, ARTIFICIAL SEQUENCE
  Engineered IL-17A binding polypeptide
VDAKYAKEADNAAYEIAGLPNLTWDQWMAFINKLRDDPSQSSELLSEAKKLNDSQAPK

SEQ ID NO: 665 - protein, 58 aa, ARTIFICIAL SEQUENCE
  Engineered IL-17A binding polypeptide
VDAKYAKEADDAAVEIADLPNLTWDQWYAFIGKLRDDPSQSSELLSEAKKLNDSQAPK

SEQ ID NO: 666 - protein, 58 aa, ARTIFICIAL SEQUENCE
  Engineered IL-17A binding polypeptide
VDAKYAKEADEAAVEIADLPNLTWAQWWAFIEKLRDDPSQSSELLSEAKKLNDSQAPK

SEQ ID NO: 667 - protein, 58 aa, ARTIFICIAL SEQUENCE
  Engineered IL-17A binding polypeptide
VDAKYAKEADDAAVEIAYLPNLTWDQWYAFITKLRDDPSQSSELLSEAKKLNDSQAPK

SEQ ID NO: 668 - protein, 58 aa, ARTIFICIAL SEQUENCE
  Engineered IL-17A binding polypeptide
VDAKYAKEADKAAVEIAYLPNLTWDQWWAFIGKLRDDPSQSSELLSEAKKLNDSQAPK

SEQ ID NO: 669 - protein, 58 aa, ARTIFICIAL SEQUENCE
  Engineered IL-17A binding polypeptide
VDAKYAKEADDAAYEIADLPNLTWDQWMAFIDKLRDDPSQSSELLSEAKKLNDSQAPK

SEQ ID NO: 670 - protein, 58 aa, ARTIFICIAL SEQUENCE
  Engineered IL-17A binding polypeptide
VDAKYAKEADDAAVEIADLPNLTWDQWFAFIDKLRDDPSQSSELLSEAKKLNDSQAPK

SEQ ID NO: 671 - protein, 58 aa, ARTIFICIAL SEQUENCE
  Engineered IL-17A binding polypeptide
VDAKYAKEADDAAVEIADLPNLTWDQWAAFIEKLRDDPSQSSELLSEAKKLNDSQAPK

SEQ ID NO: 672 - protein, 58 aa, ARTIFICIAL SEQUENCE
  Engineered IL-17A binding polypeptide
VDAKYAKEADTAAMEIADLPNLTWDQWLAFITKLRDDPSQSSELLSEAKKLNDSQAPK

SEQ ID NO: 673 - protein, 58 aa, ARTIFICIAL SEQUENCE
  Engineered IL-17A binding polypeptide
VDAKYAKEADAAAVEIADLPNLTWDQWYAFIGKLRDDPSQSSELLSEAKKLNDSQAPK

SEQ ID NO: 674 - protein, 58 aa, ARTIFICIAL SEQUENCE
  Engineered IL-17A binding polypeptide
VDAKYAKEADDAAVEIAELPNLTWDQWFAFIDKLRDDPSQSSELLSEAKKLNDSQAPK

SEQ ID NO: 675 - protein, 58 aa, ARTIFICIAL SEQUENCE
  Engineered IL-17A binding polypeptide
VDAKYAKEADDAAVEIAALPNLTWDQWEAFIHKLRDDPSQSSELLSEAKKLNDSQAPK

SEQ ID NO: 676 - protein, 58 aa, ARTIFICIAL SEQUENCE
  Engineered IL-17A binding polypeptide
VDAKYAKEADDAAYEIAYLPNLTWDQWFAFIEKLRDDPSQSSELLSEAKKLNDSQAPK

SEQ ID NO: 677 - protein, 58 aa, ARTIFICIAL SEQUENCE
  Engineered IL-17A binding polypeptide
VDAKYAKEADQAAYEIADLPNLTWDQWFAFISKLRDDPSQSSELLSEAKKLNDSQAPK

SEQ ID NO: 678 - protein, 58 aa, ARTIFICIAL SEQUENCE
  Engineered IL-17A binding polypeptide
VDAKYAKEADEAAYEIAELPNLTWDQWWAFIHKLRDDPSQSSELLSEAKKLNDSQAPK

SEQ ID NO: 679 - protein, 58 aa, ARTIFICIAL SEQUENCE
  Engineered IL-17A binding polypeptide
VDAKYAKEADDAAYEIAFLPNLTWDQWHAFIDKLRDDPSQSSELLSEAKKLNDSQAPK

SEQ ID NO: 680 - protein, 58 aa, ARTIFICIAL SEQUENCE
  Engineered IL-17A binding polypeptide
VDAKYAKEADKAAVEIADLPNLTWDQWFAFIGKLRDDPSQSSELLSEAKKLNDSQAPK

SEQ ID NO: 681 - protein, 58 aa, ARTIFICIAL SEQUENCE
  Engineered IL-17A binding polypeptide
VDAKYAKEADDAAYEIAELPNLTWDQWWAFIQKLRDDPSQSSELLSEAKKLNDSQAPK

SEQ ID NO: 682 - protein, 58 aa, ARTIFICIAL SEQUENCE
  Engineered IL-17A binding polypeptide
VDAKYAKEADEAAVEIAELPNLTWDQWWAFIQKLRDDPSQSSELLSEAKKLNDSQAPK

SEQ ID NO: 683 - protein, 58 aa, ARTIFICIAL SEQUENCE
  Engineered IL-17A binding polypeptide
VDAKYAKEADDAAYEIAELPNLTWDQWFAFIDKLRDDPSQSSELLSEAKKLNDSQAPK

SEQ ID NO: 684 - protein, 58 aa, ARTIFICIAL SEQUENCE
  Engineered IL-17A binding polypeptide
VDAKYAKEADDAAVEIAGLPNLTWDQWAAFIDKLRDDPSQSSELLSEAKKLNDSQAPK

SEQ ID NO: 685 - protein, 58 aa, ARTIFICIAL SEQUENCE
  Engineered IL-17A binding polypeptide
VDAKYAKEADSAAVEIADLPNLTWDQWYAFIQKLRDDPSQSSELLSEAKKLNDSQAPK

SEQ ID NO: 686 - protein, 58 aa, ARTIFICIAL SEQUENCE
  Engineered IL-17A binding polypeptide
VDAKYAKEADEAAVEIADLPNLTWDQWFAFIDKLRDDPSQSSELLSEAKKLNDSQAPK

SEQ ID NO: 687 - protein, 58 aa, ARTIFICIAL SEQUENCE
  Engineered IL-17A binding polypeptide
VDAKYAKEADDAAMEIADLPNLTWDQWMAFIQKLRDDPSQSSELLSEAKKLNDSQAPK

SEQ ID NO: 688 - protein, 58 aa, ARTIFICIAL SEQUENCE
  Engineered IL-17A binding polypeptide
VDAKYAKEADDAAVEIALLPNLTWDQWWAFISKLRDDPSQSSELLSEAKKLNDSQAPK

SEQ ID NO: 689 - protein, 58 aa, ARTIFICIAL SEQUENCE
  Engineered IL-17A binding polypeptide
VDAKYAKEADDAAVEIADLPNLTWEQWFAFIEKLRDDPSQSSELLSEAKKLNDSQAPK

SEQ ID NO: 690 - protein, 58 aa, ARTIFICIAL SEQUENCE
  Engineered IL-17A binding polypeptide
VDAKYAKEADEAAVEIADLPNLTWDQWFAFISKLRDDPSQSSELLSEAKKLNDSQAPK

SEQ ID NO: 691 - protein, 58 aa, ARTIFICIAL SEQUENCE
  Engineered IL-17A binding polypeptide
VDAKYAKEADQAAVEIAELPNLTWDQWYAFIQKLRDDPSQSSELLSEAKKLNDSQAPK

SEQ ID NO: 692 - protein, 58 aa, ARTIFICIAL SEQUENCE
  Engineered IL-17A binding polypeptide
VDAKYAKEADEAAVEIAYLPNLTWDQWWAFIGKLRDDPSQSSELLSEAKKLNDSQAPK

SEQ ID NO: 693 - protein, 58 aa, ARTIFICIAL SEQUENCE
  Engineered IL-17A binding polypeptide
VDAKYAKEADDAAMEIADLPNLTWDQWAAFIKKLRDDPSQSSELLSEAKKLNDSQAPK

SEQ ID NO: 694 - protein, 58 aa, ARTIFICIAL SEQUENCE
  Engineered IL-17A binding polypeptide
VDAKYAKEADDAAFEIALLPNLTWVQWEAFIEKLRDDPSQSSELLSEAKKLNDSQAPK

SEQ ID NO: 695 - protein, 58 aa, ARTIFICIAL SEQUENCE
  Engineered IL-17A binding polypeptide
VDAKYAKEADDAAYEIAQLPNLTWDQWYAFIDKLRDDPSQSSELLSEAKKLNDSQAPK

SEQ ID NO: 696 - protein, 58 aa, ARTIFICIAL SEQUENCE
  Engineered IL-17A binding polypeptide
VDAKYAKEADMAAVEIADLPNLTWDQWHAFISKLRDDPSQSSELLSEAKKLNDSQAPK

SEQ ID NO: 697 - protein, 58 aa, ARTIFICIAL SEQUENCE
  Engineered IL-17A binding polypeptide
VDAKYAKEADDAAFEIAQLPNLTWDQWFAFINKLRDDPSQSSELLSEAKKLNDSQAPK

SEQ ID NO: 698 - protein, 58 aa, ARTIFICIAL SEQUENCE
  Engineered IL-17A binding polypeptide
VDAKYAKEADDAAVEIAELPNLTWDQWYAFISKLRDDPSQSSELLSEAKKLNDSQAPK

SEQ ID NO: 699 - protein, 58 aa, ARTIFICIAL SEQUENCE
  Engineered IL-17A binding polypeptide
VDAKYAKEADDAAYEIAYLPNLTWAQWYAFISKLRDDPSQSSELLSEAKKLNDSQAPK

SEQ ID NO: 700 - protein, 58 aa, ARTIFICIAL SEQUENCE
  Engineered IL-17A binding polypeptide
VDAKYAKEADDAAMEIANLPNLTWDQWYAFINKLRDDPSQSSELLSEAKKLNDSQAPK

SEQ ID NO: 701 - protein, 58 aa, ARTIFICIAL SEQUENCE
  Engineered IL-17A binding polypeptide
VDAKYAKEADEAAYEIAMLPNLTWDQWDAFIGKLRDDPSQSSELLSEAKKLNDSQAPK

SEQ ID NO: 702 - protein, 58 aa, ARTIFICIAL SEQUENCE
  Engineered IL-17A binding polypeptide
VDAKYAKEADEAAFEIAQLPNLTWDQWFAFIDKLRDDPSQSSELLSEAKKLNDSQAPK

SEQ ID NO: 703 - protein, 58 aa, ARTIFICIAL SEQUENCE
  Engineered IL-17A binding polypeptide
VDAKYAKEADDAAVEIAELPNLTWDQWYAFINKLRDDPSQSSELLSEAKKLNDSQAPK

SEQ ID NO: 704 - protein, 58 aa, ARTIFICIAL SEQUENCE
  Engineered IL-17A binding polypeptide
VDAKYAKEADNAAFEIAGLPNLTWDQWDAFIQKLRDDPSQSSELLSEAKKLNDSQAPK

SEQ ID NO: 705 - protein, 58 aa, ARTIFICIAL SEQUENCE
  Engineered IL-17A binding polypeptide
VDAKYAKEADMAAVEIAALPNLTWDQWWAFINKLRDDPSQSSELLSEAKKLNDSQAPK

SEQ ID NO: 706 - protein, 58 aa, ARTIFICIAL SEQUENCE
  Engineered IL-17A binding polypeptide
VDAKYAKEADDAAFEIAFLPNLTWDQWWAFIQKLRDDPSQSSELLSEAKKLNDSQAPK

SEQ ID NO: 707 - protein, 58 aa, ARTIFICIAL SEQUENCE
  Engineered IL-17A binding polypeptide
VDAKYAKEADKAAVEIADLPNLTWDQWWAFINKLRDDPSQSSELLSEAKKLNDSQAPK

SEQ ID NO: 708 - protein, 58 aa, ARTIFICIAL SEQUENCE
  Engineered IL-17A binding polypeptide
VDAKYAKEADSAAVEIADLPNLTWDQWWAFIEKLRDDPSQSSELLSEAKKLNDSQAPK

SEQ ID NO: 709 - protein, 58 aa, ARTIFICIAL SEQUENCE
  Engineered IL-17A binding polypeptide
VDAKYAKEADDAAMEIAALPNLTWDQWFAFIQKLRDDPSQSSELLSEAKKLNDSQAPK

SEQ ID NO: 710 - protein, 58 aa, ARTIFICIAL SEQUENCE
  Engineered IL-17A binding polypeptide
VDAKYAKEADDAAFEIAQLPNLTWDQWWAFINKLRDDPSQSSELLSEAKKLNDSQAPK

SEQ ID NO: 711 - protein, 58 aa, ARTIFICIAL SEQUENCE
  Engineered IL-17A binding polypeptide
VDAKYAKEADQAAVEIASLPNLTWEQWYAFIAKLRDDPSQSSELLSEAKKLNDSQAPK

SEQ ID NO: 712 - protein, 58 aa, ARTIFICIAL SEQUENCE
  Engineered IL-17A binding polypeptide
VDAKYAKEADEAAYEIAELPNLTWDQWFAFINKLRDDPSQSSELLSEAKKLNDSQAPK

SEQ ID NO: 713 - protein, 58 aa, ARTIFICIAL SEQUENCE
  Engineered IL-17A binding polypeptide
VDAKYAKEADMAAVEIADLPNLTWDQWYAFIEKLRDDPSQSSELLSEAKKLNDSQAPK

SEQ ID NO: 714 - protein, 58 aa, ARTIFICIAL SEQUENCE
  Engineered IL-17A binding polypeptide
VDAKYAKEADDAAVEIADLPNLTWWQWFAFIEKLRDDPSQSSELLSEAKKLNDSQAPK

SEQ ID NO: 715 - protein, 58 aa, ARTIFICIAL SEQUENCE
  Engineered IL-17A binding polypeptide
VDAKYAKEADDAAYEIAGLPNLTWDQWYAFIDKLRDDPSQSSELLSEAKKLNDSQAPK

SEQ ID NO: 716 - protein, 58 aa, ARTIFICIAL SEQUENCE
  Engineered IL-17A binding polypeptide
VDAKYAKEADEAAVEIADLPNLTWEQWWAFIEKLRDDPSQSSELLSEAKKLNDSQAPK

SEQ ID NO: 717 - protein, 58 aa, ARTIFICIAL SEQUENCE
  Engineered IL-17A binding polypeptide
VDAKYAKEADDAAVEIADLPNLTWDQWWAFITKLRDDPSQSSELLSEAKKLNDSQAPK

SEQ ID NO: 718 - protein, 58 aa, ARTIFICIAL SEQUENCE
  Engineered IL-17A binding polypeptide
VDAKYAKEADDAAVEIAELPNLTWDQWYAFIQKLRDDPSQSSELLSEAKKLNDSQAPK

SEQ ID NO: 719 - protein, 58 aa, ARTIFICIAL SEQUENCE
  Engineered IL-17A binding polypeptide
VDAKYAKEADQAAVEIADLPNLTWDQWYAFINKLRDDPSQSSELLSEAKKLNDSQAPK

SEQ ID NO: 720 - protein, 58 aa, ARTIFICIAL SEQUENCE
  Engineered IL-17A binding polypeptide
VDAKYAKEADKAAVEIAFLPNLTWDQWYAFIHKLRDDPSQSSELLSEAKKLNDSQAPK

SEQ ID NO: 721 - protein, 58 aa, ARTIFICIAL SEQUENCE
  Engineered IL-17A binding polypeptide
VDAKYAKEADNAAVEIAELPNLTWDQWEAFIAKLRDDPSQSSELLSEAKKLNDSQAPK

SEQ ID NO: 722 - protein, 58 aa, ARTIFICIAL SEQUENCE
  Engineered IL-17A binding polypeptide
VDAKYAKEADQAAFEIAELPNLTWDQWYAFIEKLRDDPSQSSELLSEAKKLNDSQAPK

SEQ ID NO: 723 - protein, 58 aa, ARTIFICIAL SEQUENCE
  Engineered IL-17A binding polypeptide
VDAKYAKEADDAAMEIANLPNLTWDQWEAFIQKLRDDPSQSSELLSEAKKLNDSQAPK

SEQ ID NO: 724 - protein, 58 aa, ARTIFICIAL SEQUENCE
  Engineered IL-17A binding polypeptide
VDAKYAKEADDAAVEIASLPNLTWDQWYAFINKLRDDPSQSSELLSEAKKLNDSQAPK

SEQ ID NO: 725 - protein, 58 aa, ARTIFICIAL SEQUENCE
  Engineered IL-17A binding polypeptide
VDAKYAKEADDAAYEIAFLPNLTWDQWWAFISKLRDDPSQSSELLSEAKKLNDSQAPK

SEQ ID NO: 726 - protein, 58 aa, ARTIFICIAL SEQUENCE
  Engineered IL-17A binding polypeptide
VDAKYAKEADDAAIEIAELPNLTWDQWWAFINKLRDDPSQSSELLSEAKKLNDSQAPK

SEQ ID NO: 727 - protein, 58 aa, ARTIFICIAL SEQUENCE
  Engineered IL-17A binding polypeptide
VDAKYAKEADDAAMEIADLPNLTWDQWWAFINKLRDDPSQSSELLSEAKKLNDSQAPK

SEQ ID NO: 728 - protein, 58 aa, ARTIFICIAL SEQUENCE
  Engineered IL-17A binding polypeptide
VDAKYAKEADDAAVEIAMLPNLTWDQWDAFIGKLRDDPSQSSELLSEAKKLNDSQAPK

SEQ ID NO: 729 - protein, 58 aa, ARTIFICIAL SEQUENCE
  Engineered IL-17A binding polypeptide
VDAKYAKEADDAAYEIAYLPNLTWDQWFAFINKLRDDPSQSSELLSEAKKLNDSQAPK

SEQ ID NO: 730 - protein, 58 aa, ARTIFICIAL SEQUENCE
  Engineered IL-17A binding polypeptide
VDAKYAKEADDAAVEIADLPNLTWDQWWAFISKLRDDPSQSSELLSEAKKLNDSQAPK

SEQ ID NO: 731 - protein, 58 aa, ARTIFICIAL SEQUENCE
  Engineered IL-17A binding polypeptide
VDAKYAKEADDAAVEIAQLPNLTWDQWFAFIYKLRDDPSQSSELLSEAKKLNDSQAPK

SEQ ID NO: 732 - protein, 58 aa, ARTIFICIAL SEQUENCE
  Engineered IL-17A binding polypeptide
VDAKYAKEADNAAVEIADLPNLTWDQWYAFIWKLRDDPSQSSELLSEAKKLNDSQAPK

SEQ ID NO: 733 - protein, 58 aa, ARTIFICIAL SEQUENCE
  Engineered IL-17A binding polypeptide
VDAKYAKEADEAAVEIAALPNLTWDQWEAFIKKLRDDPSQSSELLSEAKKLNDSQAPK

SEQ ID NO: 734 - protein, 58 aa, ARTIFICIAL SEQUENCE
  Engineered IL-17A binding polypeptide
VDAKYAKEADGAAVEIANLPNLTWDQWFAFINKLRDDPSQSSELLSEAKKLNDSQAPK

SEQ ID NO: 735 - protein, 58 aa, ARTIFICIAL SEQUENCE
  Engineered IL-17A binding polypeptide
VDAKYAKEADDAAFEIAELPNLTWDQWWAFISKLRDDPSQSSELLSEAKKLNDSQAPK

SEQ ID NO: 736 - protein, 58 aa, ARTIFICIAL SEQUENCE
  Engineered IL-17A binding polypeptide
VDAKYAKEADDAAVEIAQLPNLTWDQWFAFIDKLRDDPSQSSELLSEAKKLNDSQAPK

SEQ ID NO: 737 - protein, 58 aa, ARTIFICIAL SEQUENCE
  Engineered IL-17A binding polypeptide
VDAKYAKEADDAAMEIALLPNLTWDQWLAFIQKLRDDPSQSSELLSEAKKLNDSQAPK

SEQ ID NO: 738 - protein, 58 aa, ARTIFICIAL SEQUENCE
  Engineered IL-17A binding polypeptide
VDAKYAKEADDAAVEIADLPNLTWDQWEAFIQKLRDDPSQSSELLSEAKKLNDSQAPK

SEQ ID NO: 739 - protein, 58 aa, ARTIFICIAL SEQUENCE
  Engineered IL-17A binding polypeptide
VDAKYAKEADAAAVEIADLPNLTWEQWWAFIEKLRDDPSQSSELLSEAKKLNDSQAPK

SEQ ID NO: 740 - protein, 58 aa, ARTIFICIAL SEQUENCE
  Engineered IL-17A binding polypeptide
VDAKYAKEADEAAYEIAMLPNLTWDQWDAFIDKLRDDPSQSSELLSEAKKLNDSQAPK

SEQ ID NO: 741 - protein, 58 aa, ARTIFICIAL SEQUENCE
  Engineered IL-17A binding polypeptide
VDAKYAKEADLAAVEIAELPNLTWAQWFAFIEKLRDDPSQSSELLSEAKKLNDSQAPK

SEQ ID NO: 742 - protein, 58 aa, ARTIFICIAL SEQUENCE
  Engineered IL-17A binding polypeptide
VDAKYAKEADDAAYEIALLPNLTWDQWWAFIEKLRDDPSQSSELLSEAKKLNDSQAPK

SEQ ID NO: 743 - protein, 58 aa, ARTIFICIAL SEQUENCE
  Engineered IL-17A binding polypeptide
VDAKYAKEADQAAMEIAELPNLTWDQWEAFITKLRDDPSQSSELLSEAKKLNDSQAPK

SEQ ID NO: 744 - protein, 58 aa, ARTIFICIAL SEQUENCE
  Engineered IL-17A binding polypeptide
VDAKYAKEADDAAVEIAELPNLTWDQWEAFIMKLRDDPSQSSELLSEAKKLNDSQAPK

SEQ ID NO: 745 - protein, 58 aa, ARTIFICIAL SEQUENCE
  Engineered IL-17A binding polypeptide
VDAKYAKEADMAAVEIASLPNLTWDQWYAFIHKLRDDPSQSSELLSEAKKLNDSQAPK

SEQ ID NO: 746 - protein, 58 aa, ARTIFICIAL SEQUENCE
  Engineered IL-17A binding polypeptide
VDAKYAKEADNAAVEIADLPNLTWDQWWAFIEKLRDDPSQSSELLSEAKKLNDSQAPK

SEQ ID NO: 747 - protein, 58 aa, ARTIFICIAL SEQUENCE
  Engineered IL-17A binding polypeptide
VDAKYAKEADDAAYEIASLPNLTWDQWWAFIEKLRDDPSQSSELLSEAKKLNDSQAPK

SEQ ID NO: 748 - protein, 58 aa, ARTIFICIAL SEQUENCE
  Engineered IL-17A binding polypeptide
VDAKYAKEADAAAVEIADLPNLTWDQWYAFISKLRDDPSQSSELLSEAKKLNDSQAPK

SEQ ID NO: 749 - protein, 58 aa, ARTIFICIAL SEQUENCE
  Engineered IL-17A binding polypeptide
VDAKYAKEADDAAYEIALLPNLTWDQWDAFIMKLRDDPSQSSELLSEAKKLNDSQAPK

SEQ ID NO: 750 - protein, 58 aa, ARTIFICIAL SEQUENCE
  Engineered IL-17A binding polypeptide
VDAKYAKEADMAAVEIADLPNLTWDQWWAFIEKLRDDPSQSSELLSEAKKLNDSQAPK

SEQ ID NO: 751 - protein, 58 aa, ARTIFICIAL SEQUENCE
  Engineered IL-17A binding polypeptide
VDAKYAKEADDAAIEIAGLPNLTWDQWFAFISKLRDDPSQSSELLSEAKKLNDSQAPK

SEQ ID NO: 752 - protein, 58 aa, ARTIFICIAL SEQUENCE
  Engineered IL-17A binding polypeptide
VDAKYAKEADEAAYEIAFLPNLTWDQWFAFIEKLRDDPSQSSELLSEAKKLNDSQAPK

SEQ ID NO: 753 - protein, 58 aa, ARTIFICIAL SEQUENCE
  Engineered IL-17A binding polypeptide
VDAKYAKEADIAAVEIADLPNLTWDQWWAFIEKLRDDPSQSSELLSEAKKLNDSQAPK

SEQ ID NO: 754 - protein, 58 aa, ARTIFICIAL SEQUENCE
  Engineered IL-17A binding polypeptide
VDAKYAKEADDAAIEIAELPNLTWDQWYAFIEKLRDDPSQSSELLSEAKKLNDSQAPK

SEQ ID NO: 755 - protein, 58 aa, ARTIFICIAL SEQUENCE
  Engineered IL-17A binding polypeptide
VDAKYAKEADIAAMEIADLPNLTWDQWWAFIGKLRDDPSQSSELLSEAKKLNDSQAPK

SEQ ID NO: 756 - protein, 58 aa, ARTIFICIAL SEQUENCE
  Engineered IL-17A binding polypeptide
VDAKYAKEADNAAMEIADLPNLTWDQWYAFIDKLRDDPSQSSELLSEAKKLNDSQAPK

SEQ ID NO: 757 - protein, 58 aa, ARTIFICIAL SEQUENCE
  Engineered IL-17A binding polypeptide
VDAKYAKEADDAAYEIADLPNLTWLQWYAFIEKLRDDPSQSSELLSEAKKLNDSQAPK

SEQ ID NO: 758 - protein, 58 aa, ARTIFICIAL SEQUENCE
  Engineered IL-17A binding polypeptide
VDAKYAKEADEAAVEIASLPNLTWDQWWAFISKLRDDPSQSSELLSEAKKLNDSQAPK

SEQ ID NO: 759 - protein, 58 aa, ARTIFICIAL SEQUENCE
  Engineered IL-17A binding polypeptide
VDAKYAKEADAAAVEIADLPNLTWWQWEAFIDKLRDDPSQSSELLSEAKKLNDSQAPK

SEQ ID NO: 760 - protein, 58 aa, ARTIFICIAL SEQUENCE
  Engineered IL-17A binding polypeptide
VDAKYAKEADMAAVEIAELPNLTWDQWYAFIDKLRDDPSQSSELLSEAKKLNDSQAPK

SEQ ID NO: 761 - protein, 58 aa, ARTIFICIAL SEQUENCE
  Engineered IL-17A binding polypeptide
VDAKYAKEADEAAMEIADLPNLTWDQWWAFIEKLRDDPSQSSELLSEAKKLNDSQAPK

SEQ ID NO: 762 - protein, 58 aa, ARTIFICIAL SEQUENCE
  Engineered IL-17A binding polypeptide
VDAKYAKEADDAAFEIAQLPNLTWDQWFAFITKLRDDPSQSSELLSEAKKLNDSQAPK

SEQ ID NO: 763 - protein, 58 aa, ARTIFICIAL SEQUENCE
  Engineered IL-17A binding polypeptide
VDAKYAKEADDAAFEIASLPNLTWDQWWAFIEKLRDDPSQSSELLSEAKKLNDSQAPK

SEQ ID NO: 764 - protein, 58 aa, ARTIFICIAL SEQUENCE
  Engineered IL-17A binding polypeptide
VDAKYAKEADDAAVEIAILPNLTWDQWFAFIAKLRDDPSQSSELLSEAKKLNDSQAPK

SEQ ID NO: 765 - protein, 58 aa, ARTIFICIAL SEQUENCE
  Engineered IL-17A binding polypeptide
VDAKYAKEADLAAVEIAELPNLTWDQWEAFILKLRDDPSQSSELLSEAKKLNDSQAPK

SEQ ID NO: 766 - protein, 58 aa, ARTIFICIAL SEQUENCE
  Engineered IL-17A binding polypeptide
VDAKYAKEADLAAVEIADLPNLTWEQWFAFIQKLRDDPSQSSELLSEAKKLNDSQAPK

SEQ ID NO: 767 - protein, 58 aa, ARTIFICIAL SEQUENCE
  Engineered IL-17A binding polypeptide
VDAKYAKEADSAAYEIAFLPNLTWDQWYAFIQKLRDDPSQSSELLSEAKKLNDSQAPK

SEQ ID NO: 768 - protein, 58 aa, ARTIFICIAL SEQUENCE
  Engineered IL-17A binding polypeptide
VDAKYAKEADDAAMEIADLPNLTWDQWFAFIEKLRDDPSQSSELLSEAKKLNDSQAPK

SEQ ID NO: 769 - protein, 58 aa, ARTIFICIAL SEQUENCE
  Engineered IL-17A binding polypeptide
VDAKYAKEADNAAVEIADLPNLTWDQWFAFIQKLRDDPSQSSELLSEAKKLNDSQAPK

SEQ ID NO: 770 - protein, 58 aa, ARTIFICIAL SEQUENCE
  Engineered IL-17A binding polypeptide
VDAKYAKEADDAAFEIAMLPNLTWDQWWAFIDKLRDDPSQSSELLSEAKKLNDSQAPK

SEQ ID NO: 771 - protein, 58 aa, ARTIFICIAL SEQUENCE
  Engineered IL-17A binding polypeptide
VDAKYAKEADEAAVEIADLPNLTWEQWWAFIGKLRDDPSQSSELLSEAKKLNDSQAPK

SEQ ID NO: 772 - protein, 58 aa, ARTIFICIAL SEQUENCE
  Engineered IL-17A binding polypeptide
VDAKYAKEADSAAYEIAFLPNLTWDQWFAFISKLRDDPSQSSELLSEAKKLNDSQAPK

SEQ ID NO: 773 - protein, 58 aa, ARTIFICIAL SEQUENCE
  Engineered IL-17A binding polypeptide
VDAKYAKEADDAAYEIAFLPNLTWDQWFAFIEKLRDDPSQSSELLSEAKKLNDSQAPK

SEQ ID NO: 774 - protein, 58 aa, ARTIFICIAL SEQUENCE
  Engineered IL-17A binding polypeptide
VDAKYAKEADDAAYEIAFLPNLTWEQWHAFIEKLRDDPSQSSELLSEAKKLNDSQAPK

SEQ ID NO: 775 - protein, 58 aa, ARTIFICIAL SEQUENCE
  Engineered IL-17A binding polypeptide
VDAKYAKEADLAALEIAELPNLTWDQWDAFIWKLRDDPSQSSELLSEAKKLNDSQAPK

SEQ ID NO: 776 - protein, 58 aa, ARTIFICIAL SEQUENCE
  Engineered IL-17A binding polypeptide
VDAKYAKEADDAAYEIAFLPNLTWDQWFAFINKLRDDPSQSSELLSEAKKLNDSQAPK

SEQ ID NO: 777 - protein, 58 aa, ARTIFICIAL SEQUENCE
  Engineered IL-17A binding polypeptide
VDAKYAKEADDAAIEIAELPNLTWDQWFAFISKLRDDPSQSSELLSEAKKLNDSQAPK

SEQ ID NO: 778 - protein, 58 aa, ARTIFICIAL SEQUENCE
  Engineered IL-17A binding polypeptide
VDAKYAKEADDAAIEIAELPNLTWEQWWAFIDKLRDDPSQSSELLSEAKKLNDSQAPK

SEQ ID NO: 779 - protein, 58 aa, ARTIFICIAL SEQUENCE
  Engineered IL-17A binding polypeptide
VDAKYAKEADMAAMEIAELPNLTWDQWEAFIMKLRDDPSQSSELLSEAKKLNDSQAPK

SEQ ID NO: 780 - protein, 58 aa, ARTIFICIAL SEQUENCE
  Engineered IL-17A binding polypeptide
VDAKYAKEADDAAYEIAFLPNLTWDQWFAFIDKLRDDPSQSSELLSEAKKLNDSQAPK

SEQ ID NO: 781 - protein, 58 aa, ARTIFICIAL SEQUENCE
  Engineered IL-17A binding polypeptide
VDAKYAKEADDAAVEIADLPNLTWDQWEAFILKLRDDPSQSSELLSEAKKLNDSQAPK

SEQ ID NO: 782 - protein, 58 aa, ARTIFICIAL SEQUENCE
  Engineered IL-17A binding polypeptide
VDAKYAKEADDAAMEIADLPNLTWDQWWAFIGKLRDDPSQSSELLSEAKKLNDSQAPK

SEQ ID NO: 783 - protein, 58 aa, ARTIFICIAL SEQUENCE
  Engineered IL-17A binding polypeptide
VDAKYAKEADRAAMEIADLPNLTWDQWDAFITKLRDDPSQSSELLSEAKKLNDSQAPK

SEQ ID NO: 784 - protein, 58 aa, ARTIFICIAL SEQUENCE
  Engineered IL-17A binding polypeptide
VDAKYAKEADDAAYEIAFLPNLTWDQWWAFIEKLRDDPSQSSELLSEAKKLNDSQAPK

SEQ ID NO: 785 - protein, 58 aa, ARTIFICIAL SEQUENCE
  Engineered IL-17A binding polypeptide
VDAKYAKEADMAAVEIADLPNLTWDQWWAFIQKLRDDPSQSSELLSEAKKLNDSQAPK

SEQ ID NO: 786 - protein, 58 aa, ARTIFICIAL SEQUENCE
  Engineered IL-17A binding polypeptide
VDAKYAKEADDAAVEIANLPNLTWDQWWAFIGKLRDDPSQSSELLSEAKKLNDSQAPK

SEQ ID NO: 787 - protein, 58 aa, ARTIFICIAL SEQUENCE
  Engineered IL-17A binding polypeptide
VDAKYAKEADDAAFEIALLPNLTWDQWHAFILKLRDDPSQSSELLSEAKKLNDSQAPK

SEQ ID NO: 788 - protein, 58 aa, ARTIFICIAL SEQUENCE
  Engineered IL-17A binding polypeptide
VDAKYAKEADDAAVEIAELPNLTWVQWWAFIEKLRDDPSQSSELLSEAKKLNDSQAPK

SEQ ID NO: 789 - protein, 58 aa, ARTIFICIAL SEQUENCE
  Engineered IL-17A binding polypeptide
VDAKYAKEADEAALEIADLPNLTWDQWWAFIEKLRDDPSQSSELLSEAKKLNDSQAPK

SEQ ID NO: 790 - protein, 58 aa, ARTIFICIAL SEQUENCE
  Engineered IL-17A binding polypeptide
VDAKYAKEADDAAVEIADLPNLTWDQWWAFIDKLRDDPSQSSELLSEAKKLNDSQAPK

SEQ ID NO: 791 - protein, 58 aa, ARTIFICIAL SEQUENCE
  Engineered IL-17A binding polypeptide
VDAKYAKEADDAAAEIADLPNLTWDQWYAFIDKLRDDPSQSSELLSEAKKLNDSQAPK

SEQ ID NO: 792 - protein, 58 aa, ARTIFICIAL SEQUENCE
  Engineered IL-17A binding polypeptide
VDAKYAKEADDAAMEIADLPNLTWDQWWAFIEKLRDDPSQSSELLSEAKKLNDSQAPK

SEQ ID NO: 793 - protein, 58 aa, ARTIFICIAL SEQUENCE
  Engineered IL-17A binding polypeptide
VDAKYAKEADEAAYEIADLPNLTWDQWWAFITKLRDDPSQSSELLSEAKKLNDSQAPK

SEQ ID NO: 794 - protein, 58 aa, ARTIFICIAL SEQUENCE
  Engineered IL-17A binding polypeptide
VDAKYAKEADNAAYEIAFLPNLTWDQWDAFITKLRDDPSQSSELLSEAKKLNDSQAPK

SEQ ID NO: 795 - protein, 58 aa, ARTIFICIAL SEQUENCE
  Engineered IL-17A binding polypeptide
VDAKYAKEADAAAVEIADLPNLTWAQWWAFIEKLRDDPSQSSELLSEAKKLNDSQAPK

SEQ ID NO: 796 - protein, 58 aa, ARTIFICIAL SEQUENCE
  Engineered IL-17A binding polypeptide
VDAKYAKEADAAAYEIAFLPNLTWDQWWAFIGKLRDDPSQSSELLSEAKKLNDSQAPK

SEQ ID NO: 797 - protein, 58 aa, ARTIFICIAL SEQUENCE
  Engineered IL-17A binding polypeptide
VDAKYAKEADAAAVEIADLPNLTWEQWWAFITKLRDDPSQSSELLSEAKKLNDSQAPK

SEQ ID NO: 798 - protein, 58 aa, ARTIFICIAL SEQUENCE
  Engineered IL-17A binding polypeptide
VDAKYAKEADAAAYEIAALPNLTWDQWWAFIRKLRDDPSQSSELLSEAKKLNDSQAPK

SEQ ID NO: 799 - protein, 58 aa, ARTIFICIAL SEQUENCE
  Engineered IL-17A binding polypeptide
VDAKYAKEADNAAFEIAELPNLTWDQWYAFIDKLRDDPSQSSELLSEAKKLNDSQAPK

SEQ ID NO: 800 - protein, 58 aa, ARTIFICIAL SEQUENCE
  Engineered IL-17A binding polypeptide
VDAKYAKEADQAAMEIADLPNLTWDQWYAFIGKLRDDPSQSSELLSEAKKLNDSQAPK

SEQ ID NO: 801 - protein, 58 aa, ARTIFICIAL SEQUENCE
  Engineered IL-17A binding polypeptide
VDAKYAKEADQAAMEIAELPNLTWDQWDAFIQKLRDDPSQSSELLSEAKKLNDSQAPK

SEQ ID NO: 802 - protein, 58 aa, ARTIFICIAL SEQUENCE
  Engineered IL-17A binding polypeptide
VDAKYAKEADEAAFEIAELPNLTWDQWFAFINKLRDDPSQSSELLSEAKKLNDSQAPK

SEQ ID NO: 803 - protein, 58 aa, ARTIFICIAL SEQUENCE
  Engineered IL-17A binding polypeptide
VDAKYAKEADDAAVEIAFLPNLTWEQWFAFIAKLRDDPSQSSELLSEAKKLNDSQAPK

SEQ ID NO: 804 - protein, 58 aa, ARTIFICIAL SEQUENCE
  Engineered IL-17A binding polypeptide
VDAKYAKEADDAAVEIANLPNLTWDQWEAFIAKLRDDPSQSSELLSEAKKLNDSQAPK

SEQ ID NO: 805 - protein, 58 aa, ARTIFICIAL SEQUENCE
  Engineered IL-17A binding polypeptide
VDAKYAKEADMAAIEIADLPNLTWDQWWAFIEKLRDDPSQSSELLSEAKKLNDSQAPK

SEQ ID NO: 806 - protein, 58 aa, ARTIFICIAL SEQUENCE
  Engineered IL-17A binding polypeptide
VDAKYAKEADQAAYEIANLPNLTWDQWWAFITKLRDDPSQSSELLSEAKKLNDSQAPK

SEQ ID NO: 807 - protein, 58 aa, ARTIFICIAL SEQUENCE
  Engineered IL-17A binding polypeptide
VDAKYAKEADQAAMEIAYLPNLTWDQWYAFIEKLRDDPSQSSELLSEAKKLNDSQAPK

SEQ ID NO: 808 - protein, 58 aa, ARTIFICIAL SEQUENCE
  Engineered IL-17A binding polypeptide
VDAKYAKEADKAAVEIAELPNLTWDQWWAFIDKLRDDPSQSSELLSEAKKLNDSQAPK

SEQ ID NO: 809 - protein, 58 aa, ARTIFICIAL SEQUENCE
  Engineered IL-17A binding polypeptide
VDAKYAKEADEAAVEIASLPNLTWDQWYAFIWKLRDDPSQSSELLSEAKKLNDSQAPK

SEQ ID NO: 810 - protein, 58 aa, ARTIFICIAL SEQUENCE
  Engineered IL-17A binding polypeptide
VDAKYAKEADMAAVEIADLPNLTWDQWWAFINKLRDDPSQSSELLSEAKKLNDSQAPK

SEQ ID NO: 811 - protein, 58 aa, ARTIFICIAL SEQUENCE
  Engineered IL-17A binding polypeptide
VDAKYAKEADAAAMEIAMLPNLTWDQWDAFISKLRDDPSQSSELLSEAKKLNDSQAPK

SEQ ID NO: 812 - protein, 58 aa, ARTIFICIAL SEQUENCE
  Engineered IL-17A binding polypeptide
VDAKYAKEADDAAYEIAFLPNLTWDQWDAFIQKLRDDPSQSSELLSEAKKLNDSQAPK

SEQ ID NO: 813 - protein, 58 aa, ARTIFICIAL SEQUENCE
  Engineered IL-17A binding polypeptide
VDAKYAKEADNAAYEIADLPNLTWDQWFAFIHKLRDDPSQSSELLSEAKKLNDSQAPK

SEQ ID NO: 814 - protein, 58 aa, ARTIFICIAL SEQUENCE
  Engineered IL-17A binding polypeptide
VDAKYAKEADDAAVEIAGLPNLTWDQWWAFIGKLRDDPSQSSELLSEAKKLNDSQAPK

SEQ ID NO: 815 - protein, 58 aa, ARTIFICIAL SEQUENCE
  Engineered IL-17A binding polypeptide
VDAKYAKEADDAAVEIAGLPNLTWDQWDAFILKLRDDPSQSSELLSEAKKLNDSQAPK

SEQ ID NO: 816 - protein, 58 aa, ARTIFICIAL SEQUENCE
  Engineered IL-17A binding polypeptide
VDAKYAKEADNAAMEIAELPNLTWDQWDAFIDKLRDDPSQSSELLSEAKKLNDSQAPK

SEQ ID NO: 817 - protein, 58 aa, ARTIFICIAL SEQUENCE
  Engineered IL-17A binding polypeptide
VDAKYAKEADMAAMEIASLPNLTWDQWFAFIDKLRDDPSQSSELLSEAKKLNDSQAPK

SEQ ID NO: 818 - protein, 58 aa, ARTIFICIAL SEQUENCE
  Engineered IL-17A binding polypeptide
VDAKYAKEADHAAVEIAALPNLTWDQWDAFIRKLRDDPSQSSELLSEAKKLNDSQAPK

SEQ ID NO: 819 - protein, 58 aa, ARTIFICIAL SEQUENCE
  Engineered IL-17A binding polypeptide
VDAKYAKEADEAAMEIADLPNLTWDQWYAFINKLRDDPSQSSELLSEAKKLNDSQAPK

SEQ ID NO: 820 - protein, 58 aa, ARTIFICIAL SEQUENCE
  Engineered IL-17A binding polypeptide
VDAKYAKEADNAAVEIADLPNLTWDQWFAFIEKLRDDPSQSSELLSEAKKLNDSQAPK

SEQ ID NO: 821 - protein, 58 aa, ARTIFICIAL SEQUENCE
  Engineered IL-17A binding polypeptide
VDAKYAKEADDAAVEIAELPNLTWDQWDAFIAKLRDDPSQSSELLSEAKKLNDSQAPK

SEQ ID NO: 822 - protein, 58 aa, ARTIFICIAL SEQUENCE
  Engineered IL-17A binding polypeptide
VDAKYAKEADDAAVEIALLPNLTWDQWWAFIEKLRDDPSQSSELLSEAKKLNDSQAPK

SEQ ID NO: 823 - protein, 58 aa, ARTIFICIAL SEQUENCE
  Engineered IL-17A binding polypeptide
VDAKYAKEADKAAVEIAYLPNLTWDQWYAFIRKLRDDPSQSSELLSEAKKLNDSQAPK

SEQ ID NO: 824 - protein, 58 aa, ARTIFICIAL SEQUENCE
  Engineered IL-17A binding polypeptide
VDAKYAKEADNAAFEIAELPNLTWDQWYAFIHKLRDDPSQSSELLSEAKKLNDSQAPK

SEQ ID NO: 825 - protein, 58 aa, ARTIFICIAL SEQUENCE
  Engineered IL-17A binding polypeptide
VDAKYAKEADAAAYEIAFLPNLTWDQWAAFIHKLRDDPSQSSELLSEAKKLNDSQAPK

SEQ ID NO: 826 - protein, 58 aa, ARTIFICIAL SEQUENCE
  Engineered IL-17A binding polypeptide
VDAKYAKEADQAAVEIADLPNLTWDQWDAFIDKLRDDPSQSSELLSEAKKLNDSQAPK

SEQ ID NO: 827 - protein, 58 aa, ARTIFICIAL SEQUENCE
  Engineered IL-17A binding polypeptide
VDAKYAKEADDAAVEIAALPNLTWDQWWAFIQKLRDDPSQSSELLSEAKKLNDSQAPK

SEQ ID NO: 828 - protein, 58 aa, ARTIFICIAL SEQUENCE
  Engineered IL-17A binding polypeptide
VDAKYAKEADEAAYEIADLPNLTWDQWWAFIHKLRDDPSQSSELLSEAKKLNDSQAPK

SEQ ID NO: 829 - protein, 58 aa, ARTIFICIAL SEQUENCE
  Engineered IL-17A binding polypeptide
VDAKYAKEADFAAVEIASLPNLTWDQWAAFIQKLRDDPSQSSELLSEAKKLNDSQAPK

SEQ ID NO: 830 - protein, 58 aa, ARTIFICIAL SEQUENCE
  Engineered IL-17A binding polypeptide
VDAKYAKEADEAAVEIAELPNLTWDQWFAFIDKLRDDPSQSSELLSEAKKLNDSQAPK

SEQ ID NO: 831 - protein, 58 aa, ARTIFICIAL SEQUENCE
  Engineered IL-17A binding polypeptide
VDAKYAKEADMAAYEIAELPNLTWDQWQAFITKLRDDPSQSSELLSEAKKLNDSQAPK

SEQ ID NO: 832 - protein, 58 aa, ARTIFICIAL SEQUENCE
  Engineered IL-17A binding polypeptide
VDAKYAKEADDAAMEIADLPNLTWWQWYAFIGKLRDDPSQSSELLSEAKKLNDSQAPK

SEQ ID NO: 833 - protein, 58 aa, ARTIFICIAL SEQUENCE
  Engineered IL-17A binding polypeptide
VDAKYAKEADDAAVEIAALPNLTWDQWFAFIGKLRDDPSQSSELLSEAKKLNDSQAPK

SEQ ID NO: 834 - protein, 58 aa, ARTIFICIAL SEQUENCE
  Engineered IL-17A binding polypeptide
VDAKYAKEADSAAYEIAFLPNLTWDQWYAFILKLRDDPSQSSELLSEAKKLNDSQAPK

SEQ ID NO: 835 - protein, 58 aa, ARTIFICIAL SEQUENCE
  Engineered IL-17A binding polypeptide
VDAKYAKEADAAAYEIAFLPNLTWDQWYAFIWKLRDDPSQSSELLSEAKKLNDSQAPK

SEQ ID NO: 836 - protein, 58 aa, ARTIFICIAL SEQUENCE
  Engineered IL-17A binding polypeptide
VDAKYAKEADQAAFEIAELPNLTWDQWYAFITKLRDDPSQSSELLSEAKKLNDSQAPK

SEQ ID NO: 837 - protein, 58 aa, ARTIFICIAL SEQUENCE
  Engineered IL-17A binding polypeptide
VDAKYAKEADEAAVEIANLPNLTWDQWEAFIRKLRDDPSQSSELLSEAKKLNDSQAPK

SEQ ID NO: 838 - protein, 58 aa, ARTIFICIAL SEQUENCE
  Engineered IL-17A binding polypeptide
VDAKYAKEADMAAYEIAGLPNLTWDQWYAFIDKLRDDPSQSSELLSEAKKLNDSQAPK

SEQ ID NO: 839 - protein, 58 aa, ARTIFICIAL SEQUENCE
  Engineered IL-17A binding polypeptide
VDAKYAKEADAAAFEIADLPNLTWDQWWAFINKLRDDPSQSSELLSEAKKLNDSQAPK

SEQ ID NO: 840 - protein, 58 aa, ARTIFICIAL SEQUENCE
  Engineered IL-17A binding polypeptide
VDAKYAKEADIAAMEIADLPNLTWDQWFAFINKLRDDPSQSSELLSEAKKLNDSQAPK

SEQ ID NO: 841 - protein, 58 aa, ARTIFICIAL SEQUENCE
  Engineered IL-17A binding polypeptide
VDAKYAKEADEAAVEIAELPNLTWDQWFAFISKLRDDPSQSSELLSEAKKLNDSQAPK

SEQ ID NO: 842 - protein, 58 aa, ARTIFICIAL SEQUENCE
  Engineered IL-17A binding polypeptide
VDAKYAKEADLAAVEIADLPNLTWDQWWAFISKLRDDPSQSSELLSEAKKLNDSQAPK

SEQ ID NO: 843 - protein, 58 aa, ARTIFICIAL SEQUENCE
  Engineered IL-17A binding polypeptide
VDAKYAKEADDAAFEIASLPNLTWDQWLAFIGKLRDDPSQSSELLSEAKKLNDSQAPK

SEQ ID NO: 844 - protein, 58 aa, ARTIFICIAL SEQUENCE
  Engineered IL-17A binding polypeptide
VDAKYAKEADMAAVEIADLPNLTWDQWFAFIGKLRDDPSQSSELLSEAKKLNDSQAPK

SEQ ID NO: 845 - protein, 58 aa, ARTIFICIAL SEQUENCE
  Engineered IL-17A binding polypeptide
VDAKYAKEADDAAVEIAYLPNLTWDQWYAFIRKLRDDPSQSSELLSEAKKLNDSQAPK

SEQ ID NO: 846 - protein, 58 aa, ARTIFICIAL SEQUENCE
  Engineered IL-17A binding polypeptide
VDAKYAKEADRAAYEIAELPNLTWDQWDAFINKLRDDPSQSSELLSEAKKLNDSQAPK

SEQ ID NO: 847 - protein, 58 aa, ARTIFICIAL SEQUENCE
  Engineered IL-17A binding polypeptide
VDAKYAKEADEAAVEIAGLPNLTWDQWFAFINKLRDDPSQSSELLSEAKKLNDSQAPK

SEQ ID NO: 848 - protein, 58 aa, ARTIFICIAL SEQUENCE
  Engineered IL-17A binding polypeptide
VDAKYAKEADHAAMEIADLPNLTWEQWAAFIDKLRDDPSQSSELLSEAKKLNDSQAPK

SEQ ID NO: 849 - protein, 58 aa, ARTIFICIAL SEQUENCE
  Engineered IL-17A binding polypeptide
VDAKYAKEADIAALEIAGLPNLTWDQWFAFIDKLRDDPSQSSELLSEAKKLNDSQAPK

SEQ ID NO: 850 - protein, 58 aa, ARTIFICIAL SEQUENCE
  Engineered IL-17A binding polypeptide
VDAKYAKEADEAAYEIAFLPNLTWDQWFAFIGKLRDDPSQSSELLSEAKKLNDSQAPK

SEQ ID NO: 851 - protein, 58 aa, ARTIFICIAL SEQUENCE
  Engineered IL-17A binding polypeptide
VDAKYAKEADRAAVEIAALPNLTWDQWDAFIGKLRDDPSQSSELLSEAKKLNDSQAPK

SEQ ID NO: 852 - protein, 58 aa, ARTIFICIAL SEQUENCE
  Engineered IL-17A binding polypeptide
VDAKYAKEADEAAVEIAELPNLTWDQWLAFINKLRDDPSQSSELLSEAKKLNDSQAPK

SEQ ID NO: 853 - protein, 58 aa, ARTIFICIAL SEQUENCE
  Engineered IL-17A binding polypeptide
VDAKYAKEADDAAMEIADLPNLTWDQWAAFIGKLRDDPSQSSELLSEAKKLNDSQAPK

SEQ ID NO: 854 - protein, 58 aa, ARTIFICIAL SEQUENCE
  Engineered IL-17A binding polypeptide
VDAKYAKEADEAAYEIALLPNLTWDQWDAFIMKLRDDPSQSSELLSEAKKLNDSQAPK

SEQ ID NO: 855 - protein, 58 aa, ARTIFICIAL SEQUENCE
  Engineered IL-17A binding polypeptide
VDAKYAKEADSAAVEIASLPNLTWDQWLAFINKLRDDPSQSSELLSEAKKLNDSQAPK

SEQ ID NO: 856 - protein, 58 aa, ARTIFICIAL SEQUENCE
  Engineered IL-17A binding polypeptide
VDAKYAKEADEAAYEIAYLPNLTWDQWFAFINKLRDDPSQSSELLSEAKKLNDSQAPK

SEQ ID NO: 857 - protein, 58 aa, ARTIFICIAL SEQUENCE
  Engineered IL-17A binding polypeptide
VDAKYAKEADMAAYEIAFLPNLTWDQWFAFITKLRDDPSQSSELLSEAKKLNDSQAPK

SEQ ID NO: 858 - protein, 58 aa, ARTIFICIAL SEQUENCE
  Engineered IL-17A binding polypeptide
VDAKYAKEADAAAMEIADLPNLTWDQWWAFIMKLRDDPSQSSELLSEAKKLNDSQAPK

SEQ ID NO: 859 - protein, 58 aa, ARTIFICIAL SEQUENCE
  Engineered IL-17A binding polypeptide
VDAKYAKEADDAAYEIAFLPNLTWDQWLAFIEKLRDDPSQSSELLSEAKKLNDSQAPK

SEQ ID NO: 860 - protein, 58 aa, ARTIFICIAL SEQUENCE
  Engineered IL-17A binding polypeptide
VDAKYAKEADDAAVEIADLPNLTWDQWYAFINKLRDDPSQSSELLSEAKKLNDSQAPK

SEQ ID NO: 861 - protein, 58 aa, ARTIFICIAL SEQUENCE
  Engineered IL-17A binding polypeptide
VDAKYAKEADEAAMEIADLPNLTWDQWFAFIDKLRDDPSQSSELLSEAKKLNDSQAPK

SEQ ID NO: 862 - protein, 58 aa, ARTIFICIAL SEQUENCE
  Engineered IL-17A binding polypeptide
VDAKYAKEADNAAVEIAELPNLTWDQWDAFITKLRDDPSQSSELLSEAKKLNDSQAPK

SEQ ID NO: 863 - protein, 58 aa, ARTIFICIAL SEQUENCE
  Engineered IL-17A binding polypeptide
VDAKYAKEADDAAYEIAFLPNLTWDQWWAFILKLRDDPSQSSELLSEAKKLNDSQAPK

SEQ ID NO: 864 - protein, 58 aa, ARTIFICIAL SEQUENCE
  Engineered IL-17A binding polypeptide
VDAKYAKEADNAAIEIADLPNLTWDQWWAFISKLRDDPSQSSELLSEAKKLNDSQAPK

SEQ ID NO: 865 - protein, 58 aa, ARTIFICIAL SEQUENCE
  Engineered IL-17A binding polypeptide
VDAKYAKEADDAAYEIAELPNLTWDQWFAFIEKLRDDPSQSSELLSEAKKLNDSQAPK

SEQ ID NO: 866 - protein, 58 aa, ARTIFICIAL SEQUENCE
  Engineered IL-17A binding polypeptide
VDAKYAKEADGAAFEIAALPNLTWDQWWAFIQKLRDDPSQSSELLSEAKKLNDSQAPK

SEQ ID NO: 867 - protein, 58 aa, ARTIFICIAL SEQUENCE
  Engineered IL-17A binding polypeptide
VDAKYAKEADDAAFEIAQLPNLTWDQWAAFIDKLRDDPSQSSELLSEAKKLNDSQAPK

SEQ ID NO: 868 - protein, 58 aa, ARTIFICIAL SEQUENCE
  Engineered IL-17A binding polypeptide
VDAKYAKEADMAALEIADLPNLTWDQWYAFIEKLRDDPSQSSELLSEAKKLNDSQAPK

SEQ ID NO: 869 - protein, 58 aa, ARTIFICIAL SEQUENCE
  Engineered IL-17A binding polypeptide
VDAKYAKEADVAAVEIAGLPNLTWDQWWAFIEKLRDDPSQSSELLSEAKKLNDSQAPK

SEQ ID NO: 870 - protein, 58 aa, ARTIFICIAL SEQUENCE
  Engineered IL-17A binding polypeptide
VDAKYAKEADIAAVEIAALPNLTWDQWDAFIDKLRDDPSQSSELLSEAKKLNDSQAPK

SEQ ID NO: 871 - protein, 58 aa, ARTIFICIAL SEQUENCE
  Engineered IL-17A binding polypeptide
VDAKYAKEADDAALEIADLPNLTWDQWWAFIGKLRDDPSQSSELLSEAKKLNDSQAPK

SEQ ID NO: 872 - protein, 58 aa, ARTIFICIAL SEQUENCE
  Engineered IL-17A binding polypeptide
VDAKYAKEADDAAYEIADLPNLTWDQWWAFIDKLRDDPSQSSELLSEAKKLNDSQAPK

SEQ ID NO: 873 - protein, 58 aa, ARTIFICIAL SEQUENCE
  Engineered IL-17A binding polypeptide
VDAKYAKEADNAAFEIAGLPNLTWDQWWAFISKLRDDPSQSSELLSEAKKLNDSQAPK

SEQ ID NO: 874 - protein, 58 aa, ARTIFICIAL SEQUENCE
  Engineered IL-17A binding polypeptide
VDAKYAKEADQAAMEIALLPNLTWDQWEAFILKLRDDPSQSSELLSEAKKLNDSQAPK

SEQ ID NO: 875 - protein, 58 aa, ARTIFICIAL SEQUENCE
  Engineered IL-17A binding polypeptide
VDAKYAKEADDAAYEIALLPNLTWDQWWAFIGKLRDDPSQSSELLSEAKKLNDSQAPK

SEQ ID NO: 876 - protein, 58 aa, ARTIFICIAL SEQUENCE
  Engineered IL-17A binding polypeptide
VDAKYAKEADDAAFEIAELPNLTWDQWFAFIQKLRDDPSQSSELLSEAKKLNDSQAPK

SEQ ID NO: 877 - protein, 58 aa, ARTIFICIAL SEQUENCE
  Engineered IL-17A binding polypeptide
VDAKYAKEADEAAVEIADLPNLTWDQWFAFIEKLRDDPSQSSELLSEAKKLNDSQAPK

SEQ ID NO: 878 - protein, 58 aa, ARTIFICIAL SEQUENCE
  Engineered IL-17A binding polypeptide
VDAKYAKEADDAAVEIANLPNLTWDQWWAFINKLRDDPSQSSELLSEAKKLNDSQAPK

SEQ ID NO: 879 - protein, 58 aa, ARTIFICIAL SEQUENCE
  Engineered IL-17A binding polypeptide
VDAKYAKEADQAAVEIADLPNLTWDQWEAFISKLRDDPSQSSELLSEAKKLNDSQAPK

SEQ ID NO: 880 - protein, 58 aa, ARTIFICIAL SEQUENCE
  Engineered IL-17A binding polypeptide
VDAKYAKEADNAAFEIANLPNLTWMQWEAFIEKLRDDPSQSSELLSEAKKLNDSQAPK

SEQ ID NO: 881 - protein, 58 aa, ARTIFICIAL SEQUENCE
  Engineered IL-17A binding polypeptide
VDAKYAKEADAAAVEIADLPNLTWYQWWAFIEKLRDDPSQSSELLSEAKKLNDSQAPK

SEQ ID NO: 882 - protein, 58 aa, ARTIFICIAL SEQUENCE
  Engineered IL-17A binding polypeptide
VDAKYAKEADDAAVEIANLPNLTWDQWLAFITKLRDDPSQSSELLSEAKKLNDSQAPK

SEQ ID NO: 883 - protein, 58 aa, ARTIFICIAL SEQUENCE
  Engineered IL-17A binding polypeptide
VDAKYAKEADDAAYEIAALPNLTWDQWWAFIEKLRDDPSQSSELLSEAKKLNDSQAPK

SEQ ID NO: 884 - protein, 58 aa, ARTIFICIAL SEQUENCE
  Engineered IL-17A binding polypeptide
VDAKYAKEADKAAYEIAELPNLTWDQWFAFIAKLRDDPSQSSELLSEAKKLNDSQAPK

SEQ ID NO: 885 - protein, 58 aa, ARTIFICIAL SEQUENCE
  Engineered IL-17A binding polypeptide
VDAKYAKEADIAAVEIADLPNLTWDQWFAFIQKLRDDPSQSSELLSEAKKLNDSQAPK

SEQ ID NO: 886 - protein, 58 aa, ARTIFICIAL SEQUENCE
  Engineered IL-17A binding polypeptide
VDAKYAKEADDAAYEIAELPNLTWDQWMAFIDKLRDDPSQSSELLSEAKKLNDSQAPK

SEQ ID NO: 887 - protein, 58 aa, ARTIFICIAL SEQUENCE
  Engineered IL-17A binding polypeptide
VDAKYAKEADNAAVEIAALPNLTWDQWWAFIGKLRDDPSQSSELLSEAKKLNDSQAPK

SEQ ID NO: 888 - protein, 58 aa, ARTIFICIAL SEQUENCE
  Engineered IL-17A binding polypeptide
VDAKYAKEADDAAVEIAELPNLTWDQWWAFIAKLRDDPSQSSELLSEAKKLNDSQAPK

SEQ ID NO: 889 - protein, 58 aa, ARTIFICIAL SEQUENCE
  Engineered IL-17A binding polypeptide
VDAKYAKEADKAAYEIAFLPNLTWDQWWAFINKLRDDPSQSSELLSEAKKLNDSQAPK

SEQ ID NO: 890 - protein, 58 aa, ARTIFICIAL SEQUENCE
  Engineered IL-17A binding polypeptide
VDAKYAKEADDAAVEIAELPNLTWDQWFAFIEKLRDDPSQSSELLSEAKKLNDSQAPK

SEQ ID NO: 891 - protein, 58 aa, ARTIFICIAL SEQUENCE
  Engineered IL-17A binding polypeptide
VDAKYAKEADDAAMEIAYLPNLTWEQWFAFIEKLRDDPSQSSELLSEAKKLNDSQAPK

SEQ ID NO: 892 - protein, 58 aa, ARTIFICIAL SEQUENCE
  Engineered IL-17A binding polypeptide
VDAKYAKEADDAAFEIALLPNLTWDQWFAFIAKLRDDPSQSSELLSEAKKLNDSQAPK

SEQ ID NO: 893 - protein, 58 aa, ARTIFICIAL SEQUENCE
  Engineered IL-17A binding polypeptide
VDAKYAKEADDAAYEIAMLPNLTWDQWHAFIEKLRDDPSQSSELLSEAKKLNDSQAPK

SEQ ID NO: 894 - protein, 58 aa, ARTIFICIAL SEQUENCE
  Engineered IL-17A binding polypeptide
VDAKYAKEADDAAFEIAMLPNLTWDQWFAFIGKLRDDPSQSSELLSEAKKLNDSQAPK

SEQ ID NO: 895 - protein, 58 aa, ARTIFICIAL SEQUENCE
  Engineered IL-17A binding polypeptide
VDAKYAKEADEAAVEIAELPNLTWDQWYAFIDKLRDDPSQSSELLSEAKKLNDSQAPK

SEQ ID NO: 896 - protein, 58 aa, ARTIFICIAL SEQUENCE
  Engineered IL-17A binding polypeptide
VDAKYAKEADDAAFEIAMLPNLTWDQWFAFINKLRDDPSQSSELLSEAKKLNDSQAPK

SEQ ID NO: 897 - protein, 58 aa, ARTIFICIAL SEQUENCE
  Engineered IL-17A binding polypeptide
VDAKYAKEADTAAVEIAFLPNLTWDQWMAFIEKLRDDPSQSSELLSEAKKLNDSQAPK

SEQ ID NO: 898 - protein, 58 aa, ARTIFICIAL SEQUENCE
  Engineered IL-17A binding polypeptide
VDAKYAKEADLAAYEIAFLPNLTWDQWWAFINKLRDDPSQSSELLSEAKKLNDSQAPK

SEQ ID NO: 899 - protein, 58 aa, ARTIFICIAL SEQUENCE
  Engineered IL-17A binding polypeptide
VDAKYAKEADAAAYEIAYLPNLTWDQWWAFISKLRDDPSQSSELLSEAKKLNDSQAPK

SEQ ID NO: 900 - protein, 58 aa, ARTIFICIAL SEQUENCE
  Engineered IL-17A binding polypeptide
VDAKYAKEADDAAYEIAGLPNLTWDQWWAFIEKLRDDPSQSSELLSEAKKLNDSQAPK

SEQ ID NO: 901 - protein, 58 aa, ARTIFICIAL SEQUENCE
  Engineered IL-17A binding polypeptide
VDAKYAKEADNAAVEIAFLPNLTWDQWYAFIEKLRDDPSQSSELLSEAKKLNDSQAPK

SEQ ID NO: 902 - protein, 58 aa, ARTIFICIAL SEQUENCE
  Engineered IL-17A binding polypeptide
VDAKYAKEADDAAYEIAYLPNLTWDQWYAFINKLRDDPSQSSELLSEAKKLNDSQAPK

SEQ ID NO: 903 - protein, 58 aa, ARTIFICIAL SEQUENCE
  Engineered IL-17A binding polypeptide
VDAKYAKEADAAALEIADLPNLTWDQWWAFIEKLRDDPSQSSELLSEAKKLNDSQAPK

SEQ ID NO: 904 - protein, 58 aa, ARTIFICIAL SEQUENCE
  Engineered IL-17A binding polypeptide
VDAKYAKEADDAAVEIADLPNLTWWQWWAFIEKLRDDPSQSSELLSEAKKLNDSQAPK

SEQ ID NO: 905 - protein, 58 aa, ARTIFICIAL SEQUENCE
  Engineered IL-17A binding polypeptide
VDAKYAKEADDAAMEIAGLPNLTWDQWAAFIGKLRDDPSQSSELLSEAKKLNDSQAPK

SEQ ID NO: 906 - protein, 58 aa, ARTIFICIAL SEQUENCE
  Engineered IL-17A binding polypeptide
VDAKYAKEADSAAYEIAQLPNLTWVQWAAFIDKLRDDPSQSSELLSEAKKLNDSQAPK

SEQ ID NO: 907 - protein, 58 aa, ARTIFICIAL SEQUENCE
  Engineered IL-17A binding polypeptide
VDAKYAKEADDAAFEIAWLPNLTWDQWFAFISKLRDDPSQSSELLSEAKKLNDSQAPK

SEQ ID NO: 908 - protein, 58 aa, ARTIFICIAL SEQUENCE
  Engineered IL-17A binding polypeptide
VDAKYAKEADEAAVEIAMLPNLTWDQWYAFIEKLRDDPSQSSELLSEAKKLNDSQAPK

SEQ ID NO: 909 - protein, 58 aa, ARTIFICIAL SEQUENCE
  Engineered IL-17A binding polypeptide
VDAKYAKEADDAALEIASLPNLTWDQWLAFIDKLRDDPSQSSELLSEAKKLNDSQAPK

SEQ ID NO: 910 - protein, 58 aa, ARTIFICIAL SEQUENCE
  Engineered IL-17A binding polypeptide
VDAKYAKEADDAAVEIAYLPNLTWDQWFAFIEKLRDDPSQSSELLSEAKKLNDSQAPK

SEQ ID NO: 911 - protein, 58 aa, ARTIFICIAL SEQUENCE
  Engineered IL-17A binding polypeptide
VDAKYAKEADDAAVEIADLPNLTWDQWWAFIEKLRDDPSQSSELLSEAKKLNDSQAPK

SEQ ID NO: 912 - protein, 58 aa, ARTIFICIAL SEQUENCE
  Engineered IL-17A binding polypeptide
VDAKYAKEADAAAVEIAELPNLTWDQWWAFIQKLRDDPSQSSELLSEAKKLNDSQAPK

SEQ ID NO: 913 - protein, 58 aa, ARTIFICIAL SEQUENCE
  Engineered IL-17A binding polypeptide
VDAKYAKEADDAAYEIAFLPNLTWDQWYAFIEKLRDDPSQSSELLSEAKKLNDSQAPK

SEQ ID NO: 914 - protein, 58 aa, ARTIFICIAL SEQUENCE
  Engineered IL-17A binding polypeptide
VDAKYAKEADDAAAEIADLPNLTWDQWAAFIDKLRDDPSQSSELLSEAKKLNDSQAPK

SEQ ID NO: 915 - protein, 58 aa, ARTIFICIAL SEQUENCE
  Engineered IL-17A binding polypeptide
VDAKYAKEADDAAFEIAVLPNLTWEQWWAFISKLRDDPSQSSELLSEAKKLNDSQAPK

SEQ ID NO: 916 - protein, 58 aa, ARTIFICIAL SEQUENCE
  Engineered IL-17A binding polypeptide
VDAKYAKEADDAAMEIADLPNLTWDQWYAFIWKLRDDPSQSSELLSEAKKLNDSQAPK

SEQ ID NO: 917 - protein, 58 aa, ARTIFICIAL SEQUENCE
  Engineered IL-17A binding polypeptide
VDAKYAKEADNAAVEIADLPNLTWDQWLAFIQKLRDDPSQSSELLSEAKKLNDSQAPK

SEQ ID NO: 918 - protein, 58 aa, ARTIFICIAL SEQUENCE
  Engineered IL-17A binding polypeptide
VDAKYAKEADDAAVEIAFLPNLTWDQWYAFILKLRDDPSQSSELLSEAKKLNDSQAPK

SEQ ID NO: 919 - protein, 58 aa, ARTIFICIAL SEQUENCE
  Engineered IL-17A binding polypeptide
VDAKYAKEADLAAYEIAYLPNLTWDQWFAFIYKLRDDPSQSSELLSEAKKLNDSQAPK

SEQ ID NO: 920 - protein, 58 aa, ARTIFICIAL SEQUENCE
  Engineered IL-17A binding polypeptide
VDAKYAKEADKAAFEIAMLPNLTWDQWDAFIRKLRDDPSQSSELLSEAKKLNDSQAPK

SEQ ID NO: 921 - protein, 58 aa, ARTIFICIAL SEQUENCE
  Engineered IL-17A binding polypeptide
VDAKYAKEADDAAFEIAFLPNLTWDQWFAFINKLRDDPSQSSELLSEAKKLNDSQAPK

SEQ ID NO: 922 - protein, 58 aa, ARTIFICIAL SEQUENCE
  Engineered IL-17A binding polypeptide
VDAKYAKEADNAAVEIASLPNLTWDQWWAFIGKLRDDPSQSSELLSEAKKLNDSQAPK

SEQ ID NO: 923 - protein, 58 aa, ARTIFICIAL SEQUENCE
  Engineered IL-17A binding polypeptide
VDAKYAKEADDAAFEIAWLPNLTWDQWWAFIGKLRDDPSQSSELLSEAKKLNDSQAPK

SEQ ID NO: 924 - protein, 58 aa, ARTIFICIAL SEQUENCE
  Engineered IL-17A binding polypeptide
VDAKYAKEADDAAVEIAELPNLTWDQWFAFINKLRDDPSQSSELLSEAKKLNDSQAPK

SEQ ID NO: 925 - protein, 58 aa, ARTIFICIAL SEQUENCE
  Engineered IL-17A binding polypeptide
VDAKYAKEADDAAYEIAWLPNLTWDQWFAFIDKLRDDPSQSSELLSEAKKLNDSQAPK

SEQ ID NO: 926 - protein, 58 aa, ARTIFICIAL SEQUENCE
  Engineered IL-17A binding polypeptide
VDAKYAKEADDAAFEIALLPNLTWDQWFAFIWKLRDDPSQSSELLSEAKKLNDSQAPK

SEQ ID NO: 927 - protein, 58 aa, ARTIFICIAL SEQUENCE
  Engineered IL-17A binding polypeptide
VDAKYAKEADDAAFEIAALPNLTWDQWYAFILKLRDDPSQSSELLSEAKKLNDSQAPK

SEQ ID NO: 928 - protein, 58 aa, ARTIFICIAL SEQUENCE
  Engineered IL-17A binding polypeptide
VDAKYAKEADMAAVEIAYLPNLTWDQWWAFIQKLRDDPSQSSELLSEAKKLNDSQAPK

SEQ ID NO: 929 - protein, 58 aa, ARTIFICIAL SEQUENCE
  Engineered IL-17A binding polypeptide
VDAKYAKEADHAAMEIASLPNLTWDQWEAFIDKLRDDPSQSSELLSEAKKLNDSQAPK

SEQ ID NO: 930 - protein, 58 aa, ARTIFICIAL SEQUENCE
  Engineered IL-17A binding polypeptide
VDAKYAKEADHAAYEIAALPNLTWDQWYAFINKLRDDPSQSSELLSEAKKLNDSQAPK

SEQ ID NO: 931 - protein, 58 aa, ARTIFICIAL SEQUENCE
  Engineered IL-17A binding polypeptide
VDAKYAKEADEAAYEIADLPNLTWDQWYAFINKLRDDPSQSSELLSEAKKLNDSQAPK

SEQ ID NO: 932 - protein, 58 aa, ARTIFICIAL SEQUENCE
  Engineered IL-17A binding polypeptide
VDAKYAKEADDAAYEIAELPNLTWDQWFAFITKLRDDPSQSSELLSEAKKLNDSQAPK

SEQ ID NO: 933 - protein, 58 aa, ARTIFICIAL SEQUENCE
  Engineered IL-17A binding polypeptide
VDAKYAKEADNAAYEIAMLPNLTWDQWMAFIDKLRDDPSQSSELLSEAKKLNDSQAPK

SEQ ID NO: 934 - protein, 58 aa, ARTIFICIAL SEQUENCE
  Engineered IL-17A binding polypeptide
VDAKYAKEADQAAVEIAALPNLTWEQWWAFITKLRDDPSQSSELLSEAKKLNDSQAPK

SEQ ID NO: 935 - protein, 58 aa, ARTIFICIAL SEQUENCE
  Engineered IL-17A binding polypeptide
VDAKYAKEADIAAVEIAGLPNLTWDQWWAFIDKLRDDPSQSSELLSEAKKLNDSQAPK

SEQ ID NO: 936 - protein, 58 aa, ARTIFICIAL SEQUENCE
  Engineered IL-17A binding polypeptide
VDAKYAKEADDAAYEIAMLPNLTWDQWFAFIQKLRDDPSQSSELLSEAKKLNDSQAPK

SEQ ID NO: 937 - protein, 58 aa, ARTIFICIAL SEQUENCE
  Engineered IL-17A binding polypeptide
VDAKYAKEADEAAVEIANLPNLTWDQWDAFIWKLRDDPSQSSELLSEAKKLNDSQAPK

SEQ ID NO: 938 - protein, 58 aa, ARTIFICIAL SEQUENCE
  Engineered IL-17A binding polypeptide
VDAKYAKEADDAAMEIADLPNLTWDQWFAFITKLRDDPSQSSELLSEAKKLNDSQAPK

SEQ ID NO: 939 - protein, 58 aa, ARTIFICIAL SEQUENCE
  Engineered IL-17A binding polypeptide
VDAKYAKEADQAAFEIAALPNLTWDQWFAFIGKLRDDPSQSSELLSEAKKLNDSQAPK

SEQ ID NO: 940 - protein, 58 aa, ARTIFICIAL SEQUENCE
  Engineered IL-17A binding polypeptide
VDAKYAKEADRAAIEIADLPNLTWDQWWAFIEKLRDDPSQSSELLSEAKKLNDSQAPK

SEQ ID NO: 941 - protein, 58 aa, ARTIFICIAL SEQUENCE
  Engineered IL-17A binding polypeptide
VDAKYAKEADEAAVEIAYLPNLTWDQWFAFINKLRDDPSQSSELLSEAKKLNDSQAPK

SEQ ID NO: 942 - protein, 58 aa, ARTIFICIAL SEQUENCE
  Engineered IL-17A binding polypeptide
VDAKYAKEADSAAVEIAELPNLTWDQWFAFIEKLRDDPSQSSELLSEAKKLNDSQAPK

SEQ ID NO: 943 - protein, 58 aa, ARTIFICIAL SEQUENCE
  Engineered IL-17A binding polypeptide
VDAKYAKEADDAAVEIAELPNLTWDQWWAFIGKLRDDPSQSSELLSEAKKLNDSQAPK

SEQ ID NO: 944 - protein, 58 aa, ARTIFICIAL SEQUENCE
  Engineered IL-17A binding polypeptide
VDAKYAKEADAAAYEIAYLPNLTWDQWWAFINKLRDDPSQSSELLSEAKKLNDSQAPK

SEQ ID NO: 945 - protein, 58 aa, ARTIFICIAL SEQUENCE
  Engineered IL-17A binding polypeptide
VDAKYAKEADEAAFEIAHLPNLTWDQWFAFIQKLRDDPSQSSELLSEAKKLNDSQAPK

SEQ ID NO: 946 - protein, 58 aa, ARTIFICIAL SEQUENCE
  Engineered IL-17A binding polypeptide
VDAKYAKEADDAAYEIAFLPNLTWDQWEAFIHKLRDDPSQSSELLSEAKKLNDSQAPK

SEQ ID NO: 947 - protein, 58 aa, ARTIFICIAL SEQUENCE
  Engineered IL-17A binding polypeptide
VDAKYAKEADDAAFEIAYLPNLTWDQWFAFITKLRDDPSQSSELLSEAKKLNDSQAPK

SEQ ID NO: 948 - protein, 58 aa, ARTIFICIAL SEQUENCE
  Engineered IL-17A binding polypeptide
VDAKYAKEADDAAYEIADLPNLTWDQWFAFINKLRDDPSQSSELLSEAKKLNDSQAPK

SEQ ID NO: 949 - protein, 58 aa, ARTIFICIAL SEQUENCE
  Engineered IL-17A binding polypeptide
VDAKYAKEADSAAYEIAGLPNLTWDQWEAFIRKLRDDPSQSSELLSEAKKLNDSQAPK

SEQ ID NO: 950 - protein, 58 aa, ARTIFICIAL SEQUENCE
  Engineered IL-17A binding polypeptide
VDAKYAKEADEAAYEIASLPNLTWDQWHAFIQKLRDDPSQSSELLSEAKKLNDSQAPK

SEQ ID NO: 951 - protein, 58 aa, ARTIFICIAL SEQUENCE
  Engineered IL-17A binding polypeptide
VDAKYAKEADDAAFEIAKLPNLTWYQWEAFIYKLRDDPSQSSELLSEAKKLNDSQAPK

SEQ ID NO: 952 - protein, 58 aa, ARTIFICIAL SEQUENCE
  Engineered IL-17A binding polypeptide
VDAKYAKEADDAAVEIAALPNLTWDQWWAFIEKLRDDPSQSSELLSEAKKLNDSQAPK

SEQ ID NO: 953 - protein, 58 aa, ARTIFICIAL SEQUENCE
  Engineered IL-17A binding polypeptide
VDAKYAKEADLAAMEIADLPNLTWDQWWAFIEKLRDDPSQSSELLSEAKKLNDSQAPK

SEQ ID NO: 954 - protein, 58 aa, ARTIFICIAL SEQUENCE
  Engineered IL-17A binding polypeptide
VDAKYAKEADQAAYEIAYLPNLTWDQWWAFINKLRDDPSQSSELLSEAKKLNDSQAPK

SEQ ID NO: 955 - protein, 58 aa, ARTIFICIAL SEQUENCE
  Engineered IL-17A binding polypeptide
VDAKYAKEADAAAIEIADLPNLTWDQWYAFIAKLRDDPSQSSELLSEAKKLNDSQAPK

SEQ ID NO: 956 - protein, 58 aa, ARTIFICIAL SEQUENCE
  Engineered IL-17A binding polypeptide
VDAKYAKEADDAAMEIADLPNLTWDQWDAFIMKLRDDPSQSSELLSEAKKLNDSQAPK

SEQ ID NO: 957 - protein, 58 aa, ARTIFICIAL SEQUENCE
  Engineered IL-17A binding polypeptide
VDAKYAKEADEAAVEIAYLPNLTWDQWFAFIQKLRDDPSQSSELLSEAKKLNDSQAPK

SEQ ID NO: 958 - protein, 58 aa, ARTIFICIAL SEQUENCE
  Engineered IL-17A binding polypeptide
VDAKYAKEADNAAVEIAELPNLTWDQWFAFIEKLRDDPSQSSELLSEAKKLNDSQAPK

SEQ ID NO: 959 - protein, 58 aa, ARTIFICIAL SEQUENCE
  Engineered IL-17A binding polypeptide
VDAKYAKEADDAAYEIAMLPNLTWDQWWAFIQKLRDDPSQSSELLSEAKKLNDSQAPK

SEQ ID NO: 960 - protein, 58 aa, ARTIFICIAL SEQUENCE
  Engineered IL-17A binding polypeptide
VDAKYAKEADNAAMEIADLPNLTWDQWAAFIDKLRDDPSQSSELLSEAKKLNDSQAPK

SEQ ID NO: 961 - protein, 58 aa, ARTIFICIAL SEQUENCE
  Engineered IL-17A binding polypeptide
VDAKYAKEADNAAVEIAYLPNLTWEQWFAFITKLRDDPSQSSELLSEAKKLNDSQAPK

SEQ ID NO: 962 - protein, 58 aa, ARTIFICIAL SEQUENCE
  Engineered IL-17A binding polypeptide
VDAKYAKEADEAAFEIAWLPNLTWDQWYAFIEKLRDDPSQSSELLSEAKKLNDSQAPK

SEQ ID NO: 963 - protein, 58 aa, ARTIFICIAL SEQUENCE
  Engineered IL-17A binding polypeptide
VDAKYAKEADEAAMEIAELPNLTWDQWWAFIGKLRDDPSQSSELLSEAKKLNDSQAPK

SEQ ID NO: 964 - protein, 58 aa, ARTIFICIAL SEQUENCE
  Engineered IL-17A binding polypeptide
VDAKYAKEADDAAFEIAMLPNLTWDQWAAFIDKLRDDPSQSSELLSEAKKLNDSQAPK

SEQ ID NO: 965 - protein, 58 aa, ARTIFICIAL SEQUENCE
  Engineered IL-17A binding polypeptide
VDAKYAKEADQAAMEIADLPNLTWDQWWAFINKLRDDPSQSSELLSEAKKLNDSQAPK

SEQ ID NO: 966 - protein, 58 aa, ARTIFICIAL SEQUENCE
  Engineered IL-17A binding polypeptide
VDAKYAKEADDAAVEIAYLPNLTWDQWWAFINKLRDDPSQSSELLSEAKKLNDSQAPK

SEQ ID NO: 967 - protein, 58 aa, ARTIFICIAL SEQUENCE
  Engineered IL-17A binding polypeptide
VDAKYAKEADDAAVEIAWLPNLTWDQWFAFIQKLRDDPSQSSELLSEAKKLNDSQAPK

SEQ ID NO: 968 - protein, 58 aa, ARTIFICIAL SEQUENCE
  Engineered IL-17A binding polypeptide
VDAKYAKEADEAAVEIADLPNLTWDQWYAFIEKLRDDPSQSSELLSEAKKLNDSQAPK

SEQ ID NO: 969 - protein, 58 aa, ARTIFICIAL SEQUENCE
  Engineered IL-17A binding polypeptide
VDAKYAKEADQAAVEIADLPNLTWDQWFAFIEKLRDDPSQSSELLSEAKKLNDSQAPK

SEQ ID NO: 970 - protein, 58 aa, ARTIFICIAL SEQUENCE
  Engineered IL-17A binding polypeptide
VDAKYAKEADQAAFEIAGLPNLTWDQWAAFIDKLRDDPSQSSELLSEAKKLNDSQAPK

SEQ ID NO: 971 - protein, 58 aa, ARTIFICIAL SEQUENCE
  Engineered IL-17A binding polypeptide
VDAKYAKEADDAAYEIAYLPNLTWEQWAAFIEKLRDDPSQSSELLSEAKKLNDSQAPK

SEQ ID NO: 972 - protein, 58 aa, ARTIFICIAL SEQUENCE
  Engineered IL-17A binding polypeptide
VDAKYAKEADDAAFEIASLPNLTWLQWEAFIMKLRDDPSQSSELLSEAKKLNDSQAPK

SEQ ID NO: 973 - protein, 58 aa, ARTIFICIAL SEQUENCE
  Engineered IL-17A binding polypeptide
VDAKYAKEADAAAVEIAALPNLTWDQWMAFIDKLRDDPSQSSELLSEAKKLNDSQAPK

SEQ ID NO: 974 - protein, 58 aa, ARTIFICIAL SEQUENCE
  Engineered IL-17A binding polypeptide
VDAKYAKEADDAAYEIAELPNLTWDQWYAFIAKLRDDPSQSSELLSEAKKLNDSQAPK

SEQ ID NO: 975 - protein, 58 aa, ARTIFICIAL SEQUENCE
  Engineered IL-17A binding polypeptide
VDAKYAKEADEAAVEIAELPNLTWDQWWAFIGKLRDDPSQSSELLSEAKKLNDSQAPK

SEQ ID NO: 976 - protein, 58 aa, ARTIFICIAL SEQUENCE
  Engineered IL-17A binding polypeptide
VDAKYAKEADDAAFEIAALPNLTWDQWAAFIDKLRDDPSQSSELLSEAKKLNDSQAPK

SEQ ID NO: 977 - protein, 58 aa, ARTIFICIAL SEQUENCE
  Engineered IL-17A binding polypeptide
VDAKYAKEADDAAVEIADLPNLTWDQWMAFINKLRDDPSQSSELLSEAKKLNDSQAPK

SEQ ID NO: 978 - protein, 58 aa, ARTIFICIAL SEQUENCE
  Engineered IL-17A binding polypeptide
VDAKYAKEADFAAMEIADLPNLTWDQWWAFIEKLRDDPSQSSELLSEAKKLNDSQAPK

SEQ ID NO: 979 - protein, 58 aa, ARTIFICIAL SEQUENCE
  Engineered IL-17A binding polypeptide
VDAKYAKEADDAAYEIAMLPNLTWDQWYAFIEKLRDDPSQSSELLSEAKKLNDSQAPK

SEQ ID NO: 980 - protein, 58 aa, ARTIFICIAL SEQUENCE
  Engineered IL-17A binding polypeptide
VDAKYAKEADEAAVEIAQLPNLTWDQWAAFIWKLRDDPSQSSELLSEAKKLNDSQAPK

SEQ ID NO: 981 - protein, 58 aa, ARTIFICIAL SEQUENCE
  Engineered IL-17A binding polypeptide
VDAKYAKEADDAAVEIAALPNLTWDQWFAFIDKLRDDPSQSSELLSEAKKLNDSQAPK

SEQ ID NO: 982 - protein, 58 aa, ARTIFICIAL SEQUENCE
  Engineered IL-17A binding polypeptide
VDAKYAKEADDAAYEIADLPNLTWDQWWAFINKLRDDPSQSSELLSEAKKLNDSQAPK

SEQ ID NO: 983 - protein, 58 aa, ARTIFICIAL SEQUENCE
  Engineered IL-17A binding polypeptide
VDAKYAKEADDAAVEIAFLPNLTWDQWAAFIEKLRDDPSQSSELLSEAKKLNDSQAPK

SEQ ID NO: 984 - protein, 58 aa, ARTIFICIAL SEQUENCE
  Engineered IL-17A binding polypeptide
VDAKYAKEADDAAMEIADLPNLTWEQWYAFIAKLRDDPSQSSELLSEAKKLNDSQAPK

SEQ ID NO: 985 - protein, 58 aa, ARTIFICIAL SEQUENCE
  Engineered IL-17A binding polypeptide
VDAKYAKEADQAAVEIADLPNLTWLQWFAFINKLRDDPSQSSELLSEAKKLNDSQAPK

SEQ ID NO: 986 - protein, 58 aa, ARTIFICIAL SEQUENCE
  Engineered IL-17A binding polypeptide
VDAKYAKEADDAAVEIAELPNLTWEQWFAFIDKLRDDPSQSSELLSEAKKLNDSQAPK

SEQ ID NO: 987 - protein, 58 aa, ARTIFICIAL SEQUENCE
  Engineered IL-17A binding polypeptide
VDAKYAKEADMAAIEIAALPNLTWDQWDAFIRKLRDDPSQSSELLSEAKKLNDSQAPK

SEQ ID NO: 988 - protein, 58 aa, ARTIFICIAL SEQUENCE
  Engineered IL-17A binding polypeptide
VDAKYAKEADEAAVEIAYLPNLTWDQWWAFISKLRDDPSQSSELLSEAKKLNDSQAPK

SEQ ID NO: 989 - protein, 58 aa, ARTIFICIAL SEQUENCE
  Engineered IL-17A binding polypeptide
VDAKYAKEADQAAVEIAELPNLTWDQWWAFINKLRDDPSQSSELLSEAKKLNDSQAPK

SEQ ID NO: 990 - protein, 58 aa, ARTIFICIAL SEQUENCE
  Engineered IL-17A binding polypeptide
VDAKYAKEADDAAIEIANLPNLTWEQWFAFINKLRDDPSQSSELLSEAKKLNDSQAPK

SEQ ID NO: 991 - protein, 58 aa, ARTIFICIAL SEQUENCE
  Engineered IL-17A binding polypeptide
VDAKYAKEADQAAFEIAELPNLTWDQWYAFIAKLRDDPSQSSELLSEAKKLNDSQAPK

SEQ ID NO: 992 - protein, 58 aa, ARTIFICIAL SEQUENCE
  Engineered IL-17A binding polypeptide
VDAKYAKEADDAAYEIAELPNLTWDQWWAFITKLRDDPSQSSELLSEAKKLNDSQAPK

SEQ ID NO: 993 - protein, 58 aa, ARTIFICIAL SEQUENCE
  Engineered IL-17A binding polypeptide
VDAKYAKEADDAAYEIAELPNLTWDQWFAFIGKLRDDPSQSSELLSEAKKLNDSQAPK

SEQ ID NO: 994 - protein, 58 aa, ARTIFICIAL SEQUENCE
  Engineered IL-17A binding polypeptide
VDAKYAKEADDAAYEIAMLPNLTWDQWYAFINKLRDDPSQSSELLSEAKKLNDSQAPK

SEQ ID NO: 995 - protein, 58 aa, ARTIFICIAL SEQUENCE
  Engineered IL-17A binding polypeptide
VDAKYAKEADDAAMEIALLPNLTWDQWWAFIEKLRDDPSQSSELLSEAKKLNDSQAPK

SEQ ID NO: 996 - protein, 58 aa, ARTIFICIAL SEQUENCE
  Engineered IL-17A binding polypeptide
VDAKYAKEADEAAVEIADLPNLTWDQWFAFIGKLRDDPSQSSELLSEAKKLNDSQAPK

SEQ ID NO: 997 - protein, 58 aa, ARTIFICIAL SEQUENCE
  Engineered IL-17A binding polypeptide
VDAKYAKEADDAAVEIAELPNLTWDQWAAFIQKLRDDPSQSSELLSEAKKLNDSQAPK

SEQ ID NO: 998 - protein, 58 aa, ARTIFICIAL SEQUENCE
  Engineered IL-17A binding polypeptide
VDAKYAKEADEAAMEIAELPNLTWDQWWAFITKLRDDPSQSSELLSEAKKLNDSQAPK

SEQ ID NO: 999 - protein, 58 aa, ARTIFICIAL SEQUENCE
  Engineered IL-17A binding polypeptide
VDAKYAKEADNAAVEIADLPNLTWDQWFAFINKLRDDPSQSSELLSEAKKLNDSQAPK

SEQ ID NO: 1000 - protein, 58 aa, ARTIFICIAL SEQUENCE
  Engineered IL-17A binding polypeptide
VDAKYAKEADDAAYEIAFLPNLTWDQWYAFIDKLRDDPSQSSELLSEAKKLNDSQAPK

SEQ ID NO: 1001 - protein, 58 aa, ARTIFICIAL SEQUENCE
  Engineered IL-17A binding polypeptide
VDAKYAKEADDAAVEIADLPNLTWDQWFAFIEKLRDDPSQSSELLSEAKKLNDSQAPK

SEQ ID NO: 1002 - protein, 58 aa, ARTIFICIAL SEQUENCE
  Engineered IL-17A binding polypeptide
VDAKYAKEADNAAAEIADLPNLTWDQWYAFIGKLRDDPSQSSELLSEAKKLNDSQAPK

SEQ ID NO: 1003 - protein, 58 aa, ARTIFICIAL SEQUENCE
  Engineered IL-17A binding polypeptide
VDAKYAKEADEAAVEIAFLPNLTWDQWWAFITKLRDDPSQSSELLSEAKKLNDSQAPK

SEQ ID NO: 1004 - protein, 58 aa, ARTIFICIAL SEQUENCE
  Engineered IL-17A binding polypeptide
VDAKYAKEADNAAVEIADLPNLTWDQWFAFIGKLRDDPSQSSELLSEAKKLNDSQAPK

SEQ ID NO: 1005 - protein, 58 aa, ARTIFICIAL SEQUENCE
  Engineered IL-17A binding polypeptide
VDAKYAKEADEAAVEIADLPNLTWDQWHAFITKLRDDPSQSSELLSEAKKLNDSQAPK

SEQ ID NO: 1006 - protein, 58 aa, ARTIFICIAL SEQUENCE
  Engineered IL-17A binding polypeptide
VDAKYAKEADDAAYEIAMLPNLTWDQWAAFIDKLRDDPSQSSELLSEAKKLNDSQAPK

SEQ ID NO: 1007 - protein, 58 aa, ARTIFICIAL SEQUENCE
  Engineered IL-17A binding polypeptide
VDAKYAKEADDAAYEIAQLPNLTWEQWFAFINKLRDDPSQSSELLSEAKKLNDSQAPK

SEQ ID NO: 1008 - protein, 58 aa, ARTIFICIAL SEQUENCE
  Engineered IL-17A binding polypeptide
VDAKYAKEADGAAYEIAGLPNLTWDQWFAFIDKLRDDPSQSSELLSEAKKLNDSQAPK

SEQ ID NO: 1009 - protein, 58 aa, ARTIFICIAL SEQUENCE
  Engineered IL-17A binding polypeptide
VDAKYAKEADNAAYEIALLPNLTWDQWEAFILKLRDDPSQSSELLSEAKKLNDSQAPK

SEQ ID NO: 1010 - protein, 58 aa, ARTIFICIAL SEQUENCE
  Engineered IL-17A binding polypeptide
VDAKYAKEADAAAMEIAGLPNLTWDQWFAFISKLRDDPSQSSELLSEAKKLNDSQAPK

SEQ ID NO: 1011 - protein, 58 aa, ARTIFICIAL SEQUENCE
  Engineered IL-17A binding polypeptide
VDAKYAKEADDAAVEIANLPNLTWDQWAAFIMKLRDDPSQSSELLSEAKKLNDSQAPK

SEQ ID NO: 1012 - protein, 58 aa, ARTIFICIAL SEQUENCE
  Engineered IL-17A binding polypeptide
VDAKYAKEADDAAVEIAELPNLTWDQWWAFINKLRDDPSQSSELLSEAKKLNDSQAPK

SEQ ID NO: 1013 - protein, 58 aa, ARTIFICIAL SEQUENCE
  Engineered IL-17A binding polypeptide
VDAKYAKEADDAAFEIAMLPNLTWDQWYAFIDKLRDDPSQSSELLSEAKKLNDSQAPK

SEQ ID NO: 1014 - protein, 58 aa, ARTIFICIAL SEQUENCE
  Engineered IL-17A binding polypeptide
VDAKYAKEADMAAVEIAELPNLTWEQWYAFIEKLRDDPSQSSELLSEAKKLNDSQAPK

SEQ ID NO: 1015 - protein, 58 aa, ARTIFICIAL SEQUENCE
  Engineered IL-17A binding polypeptide
VDAKYAKEADMAAVEIADLPNLTWDQWYAFIWKLRDDPSQSSELLSEAKKLNDSQAPK

SEQ ID NO: 1016 - protein, 58 aa, ARTIFICIAL SEQUENCE
  Engineered IL-17A binding polypeptide
VDAKYAKEADAAAMEIADLPNLTWDQWWAFITKLRDDPSQSSELLSEAKKLNDSQAPK

SEQ ID NO: 1017 - protein, 58 aa, ARTIFICIAL SEQUENCE
  Engineered IL-17A binding polypeptide
VDAKYAKEADDAAYEIAFLPNLTWDQWYAFILKLRDDPSQSSELLSEAKKLNDSQAPK

SEQ ID NO: 1018 - protein, 58 aa, ARTIFICIAL SEQUENCE
  Engineered IL-17A binding polypeptide
VDAKYAKEADQAAMEIAELPNLTWDQWEAFILKLRDDPSQSSELLSEAKKLNDSQAPK

SEQ ID NO: 1019 - protein, 58 aa, ARTIFICIAL SEQUENCE
  Engineered IL-17A binding polypeptide
VDAKYAKEADGAAYEIASLPNLTWDQWWAFIEKLRDDPSQSSELLSEAKKLNDSQAPK

SEQ ID NO: 1020 - protein, 58 aa, ARTIFICIAL SEQUENCE
  Engineered IL-17A binding polypeptide
VDAKYAKEADDAAYEIAFLPNLTWDQWDAFIMKLRDDPSQSSELLSEAKKLNDSQAPK

SEQ ID NO: 1021 - protein, 58 aa, ARTIFICIAL SEQUENCE
  Engineered IL-17A binding polypeptide
VDAKYAKEADDAAVEIAWLPNLTWDQWWAFIQKLRDDPSQSSELLSEAKKLNDSQAPK

SEQ ID NO: 1022 - protein, 58 aa, ARTIFICIAL SEQUENCE
  Engineered IL-17A binding polypeptide
VDAKYAKEADEAAVEIAYLPNLTWDQWWAFINKLRDDPSQSSELLSEAKKLNDSQAPK

SEQ ID NO: 1023 - protein, 58 aa, ARTIFICIAL SEQUENCE
  Engineered IL-17A binding polypeptide
VDAKYAKEADAAAFEIAALPNLTWDQWYAFIGKLRDDPSQSSELLSEAKKLNDSQAPK

SEQ ID NO: 1024 - protein, 58 aa, ARTIFICIAL SEQUENCE
  Engineered IL-17A binding polypeptide
VDAKYAKEADDAAYEIAELPNLTWDQWYAFIMKLRDDPSQSSELLSEAKKLNDSQAPK

SEQ ID NO: 1025 - protein, 58 aa, ARTIFICIAL SEQUENCE
  Engineered IL-17A binding polypeptide
VDAKYAKEADEAAYEIAALPNLTWDQWWAFIGKLRDDPSQSSELLSEAKKLNDSQAPK

SEQ ID NO: 1026 - protein, 58 aa, ARTIFICIAL SEQUENCE
  Engineered IL-17A binding polypeptide
VDAKYAKEADDAAVEIAALPNLTWDQWIAFIDKLRDDPSQSSELLSEAKKLNDSQAPK

SEQ ID NO: 1027 - protein, 58 aa, ARTIFICIAL SEQUENCE
  Engineered IL-17A binding polypeptide
VDAKYAKEADEAAMEIADLPNLTWEQWAAFIDKLRDDPSQSSELLSEAKKLNDSQAPK

SEQ ID NO: 1028 - protein, 58 aa, ARTIFICIAL SEQUENCE
  Engineered IL-17A binding polypeptide
VDAKYAKEADAAAVEIARLPNLTWLQWEAFILKLRDDPSQSSELLSEAKKLNDSQAPK

SEQ ID NO: 1029 - protein, 58 aa, ARTIFICIAL SEQUENCE
  Engineered IL-17A binding polypeptide
VDAKYAKEADAAAVEIAELPNLTWEQWWAFIQKLRDDPSQSSELLSEAKKLNDSQAPK

SEQ ID NO: 1030 - protein, 58 aa, ARTIFICIAL SEQUENCE
  Engineered IL-17A binding polypeptide
VDAKYAKEADDAAMEIAALPNLTWDQWWAFINKLRDDPSQSSELLSEAKKLNDSQAPK

SEQ ID NO: 1031 - protein, 58 aa, ARTIFICIAL SEQUENCE
  Engineered IL-17A binding polypeptide
VDAKYAKEADDAAFEIAFLPNLTWDQWHAFINKLRDDPSQSSELLSEAKKLNDSQAPK

SEQ ID NO: 1032 - protein, 58 aa, ARTIFICIAL SEQUENCE
  Engineered IL-17A binding polypeptide
VDAKYAKEADNAAVEIAALPNLTWIQWHAFIEKLRDDPSQSSELLSEAKKLNDSQAPK

SEQ ID NO: 1033 - protein, 58 aa, ARTIFICIAL SEQUENCE
  Engineered IL-17A binding polypeptide
VDAKYAKEADSAAVEIAVLPNLTWDQWYAFILKLRDDPSQSSELLSEAKKLNDSQAPK

SEQ ID NO: 1034 - protein, 58 aa, ARTIFICIAL SEQUENCE
  Engineered IL-17A binding polypeptide
VDAKYAKEADDAAYEIAHLPNLTWDQWEAFIGKLRDDPSQSSELLSEAKKLNDSQAPK

SEQ ID NO: 1035 - protein, 58 aa, ARTIFICIAL SEQUENCE
  Engineered IL-17A binding polypeptide
VDAKYAKEADEAAVEIAVLPNLTWDQWAAFIQKLRDDPSQSSELLSEAKKLNDSQAPK

SEQ ID NO: 1036 - protein, 58 aa, ARTIFICIAL SEQUENCE
  Engineered IL-17A binding polypeptide
VDAKYAKEADNAAMEIAELPNLTWDQWFAFIHKLRDDPSQSSELLSEAKKLNDSQAPK

SEQ ID NO: 1037 - protein, 58 aa, ARTIFICIAL SEQUENCE
  Engineered IL-17A binding polypeptide
VDAKYAKEADDAAMEIAELPNLTWEQWWAFINKLRDDPSQSSELLSEAKKLNDSQAPK

SEQ ID NO: 1038 - protein, 58 aa, ARTIFICIAL SEQUENCE
  Engineered IL-17A binding polypeptide
VDAKYAKEADDAAFEIAQLPNLTWDQWYAFIDKLRDDPSQSSELLSEAKKLNDSQAPK

SEQ ID NO: 1039 - protein, 58 aa, ARTIFICIAL SEQUENCE
  Engineered IL-17A binding polypeptide
VDAKYAKEADDAAVEIAMLPNLTWDQWWAFINKLRDDPSQSSELLSEAKKLNDSQAPK

SEQ ID NO: 1040 - protein, 58 aa, ARTIFICIAL SEQUENCE
  Engineered IL-17A binding polypeptide
VDAKYAKEADDAAYEIAELPNLTWDQWYAFITKLRDDPSQSSELLSEAKKLNDSQAPK

SEQ ID NO: 1041 - protein, 58 aa, ARTIFICIAL SEQUENCE
  Engineered IL-17A binding polypeptide
VDAKYAKEADNAALEIAELPNLTWDQWWAFIRKLRDDPSQSSELLSEAKKLNDSQAPK

SEQ ID NO: 1042 - protein, 58 aa, ARTIFICIAL SEQUENCE
  Engineered IL-17A binding polypeptide
VDAKYAKEADNAAYEIAELPNLTWDQWYAFINKLRDDPSQSSELLSEAKKLNDSQAPK

SEQ ID NO: 1043 - protein, 58 aa, ARTIFICIAL SEQUENCE
  Engineered IL-17A binding polypeptide
VDAKYAKEADLAAMEIAELPNLTWDQWYAFINKLRDDPSQSSELLSEAKKLNDSQAPK

SEQ ID NO: 1044 - protein, 58 aa, ARTIFICIAL SEQUENCE
  Engineered IL-17A binding polypeptide
VDAKYAKEADDAAVEIADLPNLTWAQWYAFINKLRDDPSQSSELLSEAKKLNDSQAPK

SEQ ID NO: 1045 - protein, 58 aa, ARTIFICIAL SEQUENCE
  Engineered IL-17A binding polypeptide
VDAKYAKEADDAAMEIAFLPNLTWDQWWAFIMKLRDDPSQSSELLSEAKKLNDSQAPK

SEQ ID NO: 1046 - protein, 58 aa, ARTIFICIAL SEQUENCE
  Engineered IL-17A binding polypeptide
VDAKYAKEADEAAVEIAHLPNLTWDQWFAFITKLRDDPSQSSELLSEAKKLNDSQAPK

SEQ ID NO: 1047 - protein, 58 aa, ARTIFICIAL SEQUENCE
  Engineered IL-17A binding polypeptide
VDAKYAKEADDAAYEIAFLPNLTWDQWWAFIGKLRDDPSQSSELLSEAKKLNDSQAPK

SEQ ID NO: 1048 - protein, 58 aa, ARTIFICIAL SEQUENCE
  Engineered IL-17A binding polypeptide
VDAKYAKEADHAAYEIAFLPNLTWDQWFAFIEKLRDDPSQSSELLSEAKKLNDSQAPK

SEQ ID NO: 1049 - protein, 58 aa, ARTIFICIAL SEQUENCE
  Engineered IL-17A binding polypeptide
VDAKYAKEADQAAVEIANLPNLTWDQWAAFIMKLRDDPSQSSELLSEAKKLNDSQAPK

SEQ ID NO: 1050 - protein, 58 aa, ARTIFICIAL SEQUENCE
  Engineered IL-17A binding polypeptide
VDAKYAKEADQAAYEIAGLPNLTWDQWAAFIEKLRDDPSQSSELLSEAKKLNDSQAPK

SEQ ID NO: 1051 - protein, 58 aa, ARTIFICIAL SEQUENCE
  Engineered IL-17A binding polypeptide
VDAKYAKEADEAAVEIALLPNLTWDQWFAFIDKLRDDPSQSSELLSEAKKLNDSQAPK

SEQ ID NO: 1052 - protein, 58 aa, ARTIFICIAL SEQUENCE
  Engineered IL-17A binding polypeptide
VDAKYAKEADEAAYEIAYLPNLTWDQWYAFISKLRDDPSQSSELLSEAKKLNDSQAPK

SEQ ID NO: 1053 - protein, 58 aa, ARTIFICIAL SEQUENCE
  Engineered IL-17A binding polypeptide
VDAKYAKEADEAAVEIAGLPNLTWDQWEAFILKLRDDPSQSSELLSEAKKLNDSQAPK

SEQ ID NO: 1054 - protein, 58 aa, ARTIFICIAL SEQUENCE
  Engineered IL-17A binding polypeptide
VDAKYAKEADDAAMEIAELPNLTWDQWWAFIAKLRDDPSQSSELLSEAKKLNDSQAPK

SEQ ID NO: 1055 - protein, 58 aa, ARTIFICIAL SEQUENCE
  Engineered IL-17A binding polypeptide
VDAKYAKEADDAALEIAYLPNLTWDQWWAFITKLRDDPSQSSELLSEAKKLNDSQAPK

SEQ ID NO: 1056 - protein, 58 aa, ARTIFICIAL SEQUENCE
  Engineered IL-17A binding polypeptide
VDAKYAKEADAAAVEIADLPNLTWDQWWAFIDKLRDDPSQSSELLSEAKKLNDSQAPK

SEQ ID NO: 1057 - protein, 58 aa, ARTIFICIAL SEQUENCE
  Engineered IL-17A binding polypeptide
VDAKYAKEADSAAVEIADLPNLTWDQWYAFIGKLRDDPSQSSELLSEAKKLNDSQAPK

SEQ ID NO: 1058 - protein, 58 aa, ARTIFICIAL SEQUENCE
  Engineered IL-17A binding polypeptide
VDAKYAKEADMAAVEIAELPNLTWDQWYAFIGKLRDDPSQSSELLSEAKKLNDSQAPK

SEQ ID NO: 1059 - protein, 58 aa, ARTIFICIAL SEQUENCE
  Engineered IL-17A binding polypeptide
VDAKYAKEADKAAVEIAELPNLTWDQWWAFIMKLRDDPSQSSELLSEAKKLNDSQAPK

SEQ ID NO: 1060 - protein, 58 aa, ARTIFICIAL SEQUENCE
  Engineered IL-17A binding polypeptide
VDAKYAKEADDAAMEIADLPNLTWDQWMAFIDKLRDDPSQSSELLSEAKKLNDSQAPK

SEQ ID NO: 1061 - protein, 58 aa, ARTIFICIAL SEQUENCE
  Engineered IL-17A binding polypeptide
VDAKYAKEADDAAVEIAGLPNLTWDQWWAFIDKLRDDPSQSSELLSEAKKLNDSQAPK

SEQ ID NO: 1062 - protein, 58 aa, ARTIFICIAL SEQUENCE
  Engineered IL-17A binding polypeptide
VDAKYAKEADDAAYEIAELPNLTWDQWFAFIAKLRDDPSQSSELLSEAKKLNDSQAPK

SEQ ID NO: 1063 - protein, 58 aa, ARTIFICIAL SEQUENCE
  Engineered IL-17A binding polypeptide
VDAKYAKEADDAAMEIALLPNLTWDQWHAFIQKLRDDPSQSSELLSEAKKLNDSQAPK

SEQ ID NO: 1064 - protein, 58 aa, ARTIFICIAL SEQUENCE
  Engineered IL-17A binding polypeptide
VDAKYAKEADIAAFEIAGLPNLTWDQWFAFIQKLRDDPSQSSELLSEAKKLNDSQAPK

SEQ ID NO: 1065 - protein, 58 aa, ARTIFICIAL SEQUENCE
  Engineered IL-17A binding polypeptide
VDAKYAKEADQAAVEIADLPNLTWDQWWAFITKLRDDPSQSSELLSEAKKLNDSQAPK

SEQ ID NO: 1066 - protein, 58 aa, ARTIFICIAL SEQUENCE
  Engineered IL-17A binding polypeptide
VDAKYAKEADMAAVEIAGLPNLTWDQWYAFINKLRDDPSQSSELLSEAKKLNDSQAPK

SEQ ID NO: 1067 - protein, 58 aa, ARTIFICIAL SEQUENCE
  Engineered IL-17A binding polypeptide
VDAKYAKEADDAAMEIAALPNLTWDQWWAFIDKLRDDPSQSSELLSEAKKLNDSQAPK

SEQ ID NO: 1068 - protein, 58 aa, ARTIFICIAL SEQUENCE
  Engineered IL-17A binding polypeptide
VDAKYAKEADDAAVEIAWLPNLTWDQWYAFIQKLRDDPSQSSELLSEAKKLNDSQAPK

SEQ ID NO: 1069 - protein, 58 aa, ARTIFICIAL SEQUENCE
  Engineered IL-17A binding polypeptide
VDAKYAKEADNAAYEIAFLPNLTWDQWYAFINKLRDDPSQSSELLSEAKKLNDSQAPK

SEQ ID NO: 1070 - protein, 58 aa, ARTIFICIAL SEQUENCE
  Engineered IL-17A binding polypeptide
VDAKYAKEADDAAFEIAALPNLTWDQWWAFIEKLRDDPSQSSELLSEAKKLNDSQAPK

SEQ ID NO: 1071 - protein, 58 aa, ARTIFICIAL SEQUENCE
  Engineered IL-17A binding polypeptide
VDAKYAKEADAAAYEIAELPNLTWDQWYAFIEKLRDDPSQSSELLSEAKKLNDSQAPK

SEQ ID NO: 1072 - protein, 58 aa, ARTIFICIAL SEQUENCE
  Engineered IL-17A binding polypeptide
VDAKYAKEADDAAYEIAFLPNLTWDQWDAFIEKLRDDPSQSSELLSEAKKLNDSQAPK

SEQ ID NO: 1073 - protein, 58 aa, ARTIFICIAL SEQUENCE
  Engineered IL-17A binding polypeptide
VDAKYAKEADDAAVEIAFLPNLTWEQWYAFIEKLRDDPSQSSELLSEAKKLNDSQAPK

SEQ ID NO: 1074 - protein, 58 aa, ARTIFICIAL SEQUENCE
  Engineered IL-17A binding polypeptide
VDAKYAKEADNAAMEIAALPNLTWDQWYAFINKLRDDPSQSSELLSEAKKLNDSQAPK

SEQ ID NO: 1075 - protein, 58 aa, ARTIFICIAL SEQUENCE
  Engineered IL-17A binding polypeptide
VDAKYAKEADDAAVEIAFLPNLTWDQWDAFINKLRDDPSQSSELLSEAKKLNDSQAPK

SEQ ID NO: 1076 - protein, 58 aa, ARTIFICIAL SEQUENCE
  Engineered IL-17A binding polypeptide
VDAKYAKEADAAAYEIALLPNLTWDQWFAFIDKLRDDPSQSSELLSEAKKLNDSQAPK

SEQ ID NO: 1077 - protein, 58 aa, ARTIFICIAL SEQUENCE
  Engineered IL-17A binding polypeptide
VDAKYAKEADDAAYEIAGLPNLTWDQWWAFISKLRDDPSQSSELLSEAKKLNDSQAPK

SEQ ID NO: 1078 - protein, 58 aa, ARTIFICIAL SEQUENCE
  Engineered IL-17A binding polypeptide
VDAKYAKEADDAAFEIAELPNLTWDQWWAFITKLRDDPSQSSELLSEAKKLNDSQAPK

SEQ ID NO: 1079 - protein, 58 aa, ARTIFICIAL SEQUENCE
  Engineered IL-17A binding polypeptide
VDAKYAKEADEAAMEIADLPNLTWAQWYAFIDKLRDDPSQSSELLSEAKKLNDSQAPK

SEQ ID NO: 1080 - protein, 58 aa, ARTIFICIAL SEQUENCE
  Engineered IL-17A binding polypeptide
VDAKYAKEADMAAVEIAALPNLTWDQWYAFIEKLRDDPSQSSELLSEAKKLNDSQAPK

SEQ ID NO: 1081 - protein, 58 aa, ARTIFICIAL SEQUENCE
  Engineered IL-17A binding polypeptide
VDAKYAKEADNAAVEIAELPNLTWEQWWAFINKLRDDPSQSSELLSEAKKLNDSQAPK

SEQ ID NO: 1082 - protein, 58 aa, ARTIFICIAL SEQUENCE
  Engineered IL-17A binding polypeptide
VDAKYAKEADIAAVEIALLPNLTWDQWAAFISKLRDDPSQSSELLSEAKKLNDSQAPK

SEQ ID NO: 1083 - protein, 58 aa, ARTIFICIAL SEQUENCE
  Engineered IL-17A binding polypeptide
VDAKYAKEADRAAVEIASLPNLTWDQWYAFITKLRDDPSQSSELLSEAKKLNDSQAPK

SEQ ID NO: 1084 - protein, 58 aa, ARTIFICIAL SEQUENCE
  Engineered IL-17A binding polypeptide
VDAKYAKEADAAAVEIANLPNLTWDQWEAFIHKLRDDPSQSSELLSEAKKLNDSQAPK

SEQ ID NO: 1085 - protein, 58 aa, ARTIFICIAL SEQUENCE
  Engineered IL-17A binding polypeptide
VDAKYAKEADDAAVEIALLPNLTWDQWFAFIMKLRDDPSQSSELLSEAKKLNDSQAPK

SEQ ID NO: 1086 - protein, 58 aa, ARTIFICIAL SEQUENCE
  Engineered IL-17A binding polypeptide
VDAKYAKEADDAAVEIANLPNLTWAQWHAFIQKLRDDPSQSSELLSEAKKLNDSQAPK

SEQ ID NO: 1087 - protein, 58 aa, ARTIFICIAL SEQUENCE
  Engineered IL-17A binding polypeptide
VDAKYAKEADNAAVEIAWLPNLTWDQWFAFITKLRDDPSQSSELLSEAKKLNDSQAPK

SEQ ID NO: 1088 - protein, 58 aa, ARTIFICIAL SEQUENCE
  Engineered IL-17A binding polypeptide
VDAKYAKEADFAAIEIAELPNLTWDQWHAFIAKLRDDPSQSSELLSEAKKLNDSQAPK

SEQ ID NO: 1089 - protein, 58 aa, ARTIFICIAL SEQUENCE
  Engineered IL-17A binding polypeptide
VDAKYAKEADIAAFEIAMLPNLTWLQWEAFIAKLRDDPSQSSELLSEAKKLNDSQAPK

SEQ ID NO: 1090 - protein, 58 aa, ARTIFICIAL SEQUENCE
  Engineered IL-17A binding polypeptide
VDAKYAKEADGAAMEIALLPNLTWDQWYAFINKLRDDPSQSSELLSEAKKLNDSQAPK

SEQ ID NO: 1091 - protein, 58 aa, ARTIFICIAL SEQUENCE
  Engineered IL-17A binding polypeptide
VDAKYAKEADAAAMEIAFLPNLTWDQWDAFILKLRDDPSQSSELLSEAKKLNDSQAPK

SEQ ID NO: 1092 - protein, 58 aa, ARTIFICIAL SEQUENCE
  Engineered IL-17A binding polypeptide
VDAKYAKEADAAAMEIANLPNLTWDQWAAFIRKLRDDPSQSSELLSEAKKLNDSQAPK

SEQ ID NO: 1093 - protein, 58 aa, ARTIFICIAL SEQUENCE
  Engineered IL-17A binding polypeptide
VDAKYAKEADDAAYEIAGLPNLTWLQWDAFIQKLRDDPSQSSELLSEAKKLNDSQAPK

SEQ ID NO: 1094 - protein, 58 aa, ARTIFICIAL SEQUENCE
  Engineered IL-17A binding polypeptide
VDAKYAKEADLAAIEIANLPNLTWDQWHAFIFKLRDDPSQSSELLSEAKKLNDSQAPK

SEQ ID NO: 1095 - protein, 58 aa, ARTIFICIAL SEQUENCE
  Engineered IL-17A binding polypeptide
VDAKYAKEADRAAYEIAELPNLTWDQWYAFISKLRDDPSQSSELLSEAKKLNDSQAPK

SEQ ID NO: 1096 - protein, 58 aa, ARTIFICIAL SEQUENCE
  Engineered IL-17A binding polypeptide
VDAKYAKEADHAAYEIAGLPNLTWDQWHAFISKLRDDPSQSSELLSEAKKLNDSQAPK

SEQ ID NO: 1097 - protein, 58 aa, ARTIFICIAL SEQUENCE
  Engineered IL-17A binding polypeptide
VDAKYAKEADNAAIEIALLPNLTWDQWWAFILKLRDDPSQSSELLSEAKKLNDSQAPK

SEQ ID NO: 1098 - protein, 58 aa, ARTIFICIAL SEQUENCE
  Engineered IL-17A binding polypeptide
VDAKYAKEADAAAVEIAALPNLTWDQWDAFIFKLRDDPSQSSELLSEAKKLNDSQAPK

SEQ ID NO: 1099 - protein, 58 aa, ARTIFICIAL SEQUENCE
  Engineered IL-17A binding polypeptide
VDAKYAKEADTAAVEIAQLPNLTWDQWAAFIQKLRDDPSQSSELLSEAKKLNDSQAPK

SEQ ID NO: 1100 - protein, 58 aa, ARTIFICIAL SEQUENCE
  Engineered IL-17A binding polypeptide
VDAKYAKEADRAAVEIAHLPNLTWIQWEAFINKLRDDPSQSSELLSEAKKLNDSQAPK

SEQ ID NO: 1101 - protein, 58 aa, ARTIFICIAL SEQUENCE
  Engineered IL-17A binding polypeptide
VDAKYAKEADSAAVEIAELPNLTWDQWWAFIRKLRDDPSQSSELLSEAKKLNDSQAPK

SEQ ID NO: 1102 - protein, 58 aa, ARTIFICIAL SEQUENCE
  Engineered IL-17A binding polypeptide
VDAKYAKEADQAAFEIAGLPNLTWDQWFAFIRKLRDDPSQSSELLSEAKKLNDSQAPK

SEQ ID NO: 1103 - protein, 58 aa, ARTIFICIAL SEQUENCE
  Engineered IL-17A binding polypeptide
VDAKYAKEADEAAVEIAALPNLTWDQWLAFILKLRDDPSQSSELLSEAKKLNDSQAPK

SEQ ID NO: 1104 - protein, 58 aa, ARTIFICIAL SEQUENCE
  Engineered IL-17A binding polypeptide
VDAKYAKEADNAAVEIANLPNLTWLQWWAFINKLRDDPSQSSELLSEAKKLNDSQAPK

SEQ ID NO: 1105 - protein, 58 aa, ARTIFICIAL SEQUENCE
  Engineered IL-17A binding polypeptide
VDAKYAKEADIAALEIANLPNLTWDQWWAFITKLRDDPSQSSELLSEAKKLNDSQAPK

SEQ ID NO: 1106 - protein, 58 aa, ARTIFICIAL SEQUENCE
  Engineered IL-17A binding polypeptide
VDAKYAKEADIAAVEIAWLPNLTWAQWHAFITKLRDDPSQSSELLSEAKKLNDSQAPK

SEQ ID NO: 1107 - protein, 58 aa, ARTIFICIAL SEQUENCE
  Engineered IL-17A binding polypeptide
VDAKYAKEADVAAAEIAELPNLTWDQWAAFIAKLRDDPSQSSELLSEAKKLNDSQAPK

SEQ ID NO: 1108 - protein, 58 aa, ARTIFICIAL SEQUENCE
  Engineered IL-17A binding polypeptide
VDAKYAKEADDAAVEIAELPNLTWMQWEAFISKLRDDPSQSSELLSEAKKLNDSQAPK

SEQ ID NO: 1109 - protein, 58 aa, ARTIFICIAL SEQUENCE
  Engineered IL-17A binding polypeptide
VDAKYAKEADQAAMEIAKLPNLTWDQWYAFITKLRDDPSQSSELLSEAKKLNDSQAPK

SEQ ID NO: 1110 - protein, 58 aa, ARTIFICIAL SEQUENCE
  Engineered IL-17A binding polypeptide
VDAKYAKEADQAAYEIADLPNLTWDQWFAFINKLRDDPSQSSELLSEAKKLNDSQAPK

SEQ ID NO: 1111 - protein, 58 aa, ARTIFICIAL SEQUENCE
  Engineered IL-17A binding polypeptide
VDAKYAKEADKAAYEIAQLPNLTWEQWWAFIDKLRDDPSQSSELLSEAKKLNDSQAPK

SEQ ID NO: 1112 - protein, 58 aa, ARTIFICIAL SEQUENCE
  Engineered IL-17A binding polypeptide
VDAKYAKEADDAAVEIAWLPNLTWDQWYAFITKLRDDPSQSSELLSEAKKLNDSQAPK

SEQ ID NO: 1113 - protein, 58 aa, ARTIFICIAL SEQUENCE
  Engineered IL-17A binding polypeptide
VDAKYAKEADRAAVEIANLPNLTWWQWEAFIAKLRDDPSQSSELLSEAKKLNDSQAPK

SEQ ID NO: 1114 - protein, 58 aa, ARTIFICIAL SEQUENCE
  Engineered IL-17A binding polypeptide
VDAKYAKEADEAAMEIANLPNLTWEQWWAFIQKLRDDPSQSSELLSEAKKLNDSQAPK

SEQ ID NO: 1115 - protein, 58 aa, ARTIFICIAL SEQUENCE
  Engineered IL-17A binding polypeptide
VDAKYAKEADTAAYEIANLPNLTWDQWFAFIEKLRDDPSQSSELLSEAKKLNDSQAPK

SEQ ID NO: 1116 - protein, 58 aa, ARTIFICIAL SEQUENCE
  Engineered IL-17A binding polypeptide
VDAKYAKEADDAAIEIADLPNLTWIQWLAFIEKLRDDPSQSSELLSEAKKLNDSQAPK

SEQ ID NO: 1117 - protein, 58 aa, ARTIFICIAL SEQUENCE
  Engineered IL-17A binding polypeptide
VDAKYAKEADDAAIEIALLPNLTWFQWDAFINKLRDDPSQSSELLSEAKKLNDSQAPK

SEQ ID NO: 1118 - protein, 58 aa, ARTIFICIAL SEQUENCE
  Engineered IL-17A binding polypeptide
VDAKYAKEADRAAMEIASLPNLTWDQWWAFIQKLRDDPSQSSELLSEAKKLNDSQAPK

SEQ ID NO: 1119 - protein, 58 aa, ARTIFICIAL SEQUENCE
  Engineered IL-17A binding polypeptide
VDAKYAKEADKAAVEIAQLPNLTWDQWWAFIMKLRDDPSQSSELLSEAKKLNDSQAPK

SEQ ID NO: 1120 - protein, 58 aa, ARTIFICIAL SEQUENCE
  Engineered IL-17A binding polypeptide
VDAKYAKEADMAALEIAELPNLTWDQWYAFIDKLRDDPSQSSELLSEAKKLNDSQAPK

SEQ ID NO: 1121 - protein, 58 aa, ARTIFICIAL SEQUENCE
  Engineered IL-17A binding polypeptide
VDAKYAKEADGAAVEIAMLPNLTWDQWWAFITKLRDDPSQSSELLSEAKKLNDSQAPK

SEQ ID NO: 1122 - protein, 58 aa, ARTIFICIAL SEQUENCE
  Engineered IL-17A binding polypeptide
VDAKYAKEADDAAYEIAELPNLTWDQWYAFIDKLRDDPSQSSELLSEAKKLNDSQAPK

SEQ ID NO: 1123 - protein, 58 aa, ARTIFICIAL SEQUENCE
  Engineered IL-17A binding polypeptide
VDAKYAKEADNAAYEIAQLPNLTWDQWFAFIEKLRDDPSQSSELLSEAKKLNDSQAPK

SEQ ID NO: 1124 - protein, 58 aa, ARTIFICIAL SEQUENCE
  Engineered IL-17A binding polypeptide
VDAKYAKEADAAAVEIAELPNLTWDQWLAFISKLRDDPSQSSELLSEAKKLNDSQAPK

SEQ ID NO: 1125 - protein, 58 aa, ARTIFICIAL SEQUENCE
  Engineered IL-17A binding polypeptide
VDAKYAKEADSAAYEIAGLPNLTWDQWDAFISKLRDDPSQSSELLSEAKKLNDSQAPK

SEQ ID NO: 1126 - protein, 58 aa, ARTIFICIAL SEQUENCE
  Engineered IL-17A binding polypeptide
VDAKYAKEADGAAYEIALLPNLTWDQWAAFIDKLRDDPSQSSELLSEAKKLNDSQAPK

SEQ ID NO: 1127 - protein, 58 aa, ARTIFICIAL SEQUENCE
  Engineered IL-17A binding polypeptide
VDAKYAKEADSAAIEIAYLPNLTWDQWYAFIEKLRDDPSQSSELLSEAKKLNDSQAPK

SEQ ID NO: 1128 - protein, 58 aa, ARTIFICIAL SEQUENCE
  Engineered IL-17A binding polypeptide
VDAKYAKEADLAAIEIAYLPNLTWDQWAAFIRKLRDDPSQSSELLSEAKKLNDSQAPK

SEQ ID NO: 1129 - protein, 58 aa, ARTIFICIAL SEQUENCE
  Engineered IL-17A binding polypeptide
VDAKYAKEADDAAFEIAYLPNLTWEQWWAFIKKLRDDPSQSSELLSEAKKLNDSQAPK

SEQ ID NO: 1130 - protein, 58 aa, ARTIFICIAL SEQUENCE
  Engineered IL-17A binding polypeptide
VDAKYAKEADEAAVEIAVLPNLTWEQWFAFIMKLRDDPSQSSELLSEAKKLNDSQAPK

SEQ ID NO: 1131 - protein, 58 aa, ARTIFICIAL SEQUENCE
  Engineered IL-17A binding polypeptide
VDAKYAKEADDAAMEIAMLPNLTWDQWYAFIEKLRDDPSQSSELLSEAKKLNDSQAPK

SEQ ID NO: 1132 - protein, 58 aa, ARTIFICIAL SEQUENCE
  Engineered IL-17A binding polypeptide
VDAKYAKEADEAAMEIAALPNLTWDQWYAFIGKLRDDPSQSSELLSEAKKLNDSQAPK

SEQ ID NO: 1133 - protein, 58 aa, ARTIFICIAL SEQUENCE
  Engineered IL-17A binding polypeptide
VDAKYAKEADFAAFEIAELPNLTWEQWFAFINKLRDDPSQSSELLSEAKKLNDSQAPK

SEQ ID NO: 1134 - protein, 58 aa, ARTIFICIAL SEQUENCE
  Engineered IL-17A binding polypeptide
VDAKYAKEADNAAMEIANLPNLTWAQWAAFIGKLRDDPSQSSELLSEAKKLNDSQAPK

SEQ ID NO: 1135 - protein, 58 aa, ARTIFICIAL SEQUENCE
  Engineered IL-17A binding polypeptide
VDAKYAKEADDAAVEIANLPNLTWIQWEAFIQKLRDDPSQSSELLSEAKKLNDSQAPK

SEQ ID NO: 1136 - protein, 58 aa, ARTIFICIAL SEQUENCE
  Engineered IL-17A binding polypeptide
VDAKYAKEADDAALEIAQLPNLTWDQWEAFILKLRDDPSQSSELLSEAKKLNDSQAPK

SEQ ID NO: 1137 - protein, 58 aa, ARTIFICIAL SEQUENCE
  Engineered IL-17A binding polypeptide
VDAKYAKEADDAAFEIAHLPNLTWLQWAAFIKKLRDDPSQSSELLSEAKKLNDSQAPK

SEQ ID NO: 1138 - protein, 58 aa, ARTIFICIAL SEQUENCE
  Engineered IL-17A binding polypeptide
VDAKYAKEADEAAMEIALLPNLTWDQWWAFITKLRDDPSQSSELLSEAKKLNDSQAPK

SEQ ID NO: 1139 - protein, 58 aa, ARTIFICIAL SEQUENCE
  Engineered IL-17A binding polypeptide
VDAKYAKEADLAAMEIAELPNLTWDQWFAFIYKLRDDPSQSSELLSEAKKLNDSQAPK

SEQ ID NO: 1140 - protein, 58 aa, ARTIFICIAL SEQUENCE
  Engineered IL-17A binding polypeptide
VDAKYAKEADHAAVEIAILPNLTWAQWMAFIEKLRDDPSQSSELLSEAKKLNDSQAPK

SEQ ID NO: 1141 - protein, 58 aa, ARTIFICIAL SEQUENCE
  Engineered IL-17A binding polypeptide
VDAKYAKEADKAAVEIANLPNLTWIQWWAFIRKLRDDPSQSSELLSEAKKLNDSQAPK

SEQ ID NO: 1142 - protein, 58 aa, ARTIFICIAL SEQUENCE
  Engineered IL-17A binding polypeptide
VDAKYAKEADKAAFEIAILPNLTWDQWYAFIWKLRDDPSQSSELLSEAKKLNDSQAPK

SEQ ID NO: 1143 - protein, 58 aa, ARTIFICIAL SEQUENCE
  Engineered IL-17A binding polypeptide
VDAKYAKEADEAAVEIAELPNLTWDQWWAFIMKLRDDPSQSSELLSEAKKLNDSQAPK

SEQ ID NO: 1144 - protein, 58 aa, ARTIFICIAL SEQUENCE
  Engineered IL-17A binding polypeptide
VDAKYAKEADRAAVEIAHLPNLTWDQWFAFIEKLRDDPSQSSELLSEAKKLNDSQAPK

SEQ ID NO: 1145 - protein, 58 aa, ARTIFICIAL SEQUENCE
  Engineered IL-17A binding polypeptide
VDAKYAKEADGAAMEIAELPNLTWDQWDAFIRKLRDDPSQSSELLSEAKKLNDSQAPK

SEQ ID NO: 1146 - protein, 58 aa, ARTIFICIAL SEQUENCE
  Engineered IL-17A binding polypeptide
VDAKYAKEADMAAIEIADLPNLTWYQWYAFISKLRDDPSQSSELLSEAKKLNDSQAPK

SEQ ID NO: 1147 - protein, 58 aa, ARTIFICIAL SEQUENCE
  Engineered IL-17A binding polypeptide
VDAKYAKEADKAAVEIAMLPNLTWDQWYAFIMKLRDDPSQSSELLSEAKKLNDSQAPK

SEQ ID NO: 1148 - protein, 58 aa, ARTIFICIAL SEQUENCE
  Engineered IL-17A binding polypeptide
VDAKYAKEADRAAVEIAYLPNLTWDQWWAFIQKLRDDPSQSSELLSEAKKLNDSQAPK

SEQ ID NO: 1149 - protein, 58 aa, ARTIFICIAL SEQUENCE
  Engineered IL-17A binding polypeptide
VDAKYAKEADDAAMEIAWLPNLTWYQWWAFIQKLRDDPSQSSELLSEAKKLNDSQAPK

SEQ ID NO: 1150 - protein, 58 aa, ARTIFICIAL SEQUENCE
  Engineered IL-17A binding polypeptide
VDAKYAKEADMAAYEIAGLPNLTWDQWWAFIDKLRDDPSQSSELLSEAKKLNDSQAPK

SEQ ID NO: 1151 - protein, 58 aa, ARTIFICIAL SEQUENCE
  Engineered IL-17A binding polypeptide
VDAKYAKEADHAALEIAELPNLTWDQWAAFINKLRDDPSQSSELLSEAKKLNDSQAPK

SEQ ID NO: 1152 - protein, 58 aa, ARTIFICIAL SEQUENCE
  Engineered IL-17A binding polypeptide
VDAKYAKEADTAAVEIAMLPNLTWWQWEAFIMKLRDDPSQSSELLSEAKKLNDSQAPK

SEQ ID NO: 1153 - protein, 58 aa, ARTIFICIAL SEQUENCE
  Engineered IL-17A binding polypeptide
VDAKYAKEADEAAYEIAFLPNLTWDQWAAFIYKLRDDPSQSSELLSEAKKLNDSQAPK

SEQ ID NO: 1154 - protein, 58 aa, ARTIFICIAL SEQUENCE
  Engineered IL-17A binding polypeptide
VDAKYAKEADSAAYEIAALPNLTWDQWWAFIQKLRDDPSQSSELLSEAKKLNDSQAPK

SEQ ID NO: 1155 - protein, 58 aa, ARTIFICIAL SEQUENCE
  Engineered IL-17A binding polypeptide
VDAKYAKEADNAAMEIAHLPNLTWDQWYAFIAKLRDDPSQSSELLSEAKKLNDSQAPK

SEQ ID NO: 1156 - protein, 58 aa, ARTIFICIAL SEQUENCE
  Engineered IL-17A binding polypeptide
VDAKYAKEADKAAFEIAALPNLTWVQWMAFIAKLRDDPSQSSELLSEAKKLNDSQAPK

SEQ ID NO: 1157 - protein, 58 aa, ARTIFICIAL SEQUENCE
  Engineered IL-17A binding polypeptide
VDAKYAKEADDAAVEIAHLPNLTWDQWEAFIFKLRDDPSQSSELLSEAKKLNDSQAPK

SEQ ID NO: 1158 - protein, 58 aa, ARTIFICIAL SEQUENCE
  Engineered IL-17A binding polypeptide
VDAKYAKEADFAALEIASLPNLTWAQWYAFINKLRDDPSQSSELLSEAKKLNDSQAPK

SEQ ID NO: 1159 - protein, 58 aa, ARTIFICIAL SEQUENCE
  Engineered IL-17A binding polypeptide
VDAKYAKEADHAAMEIAELPNLTWLQWHAFIAKLRDDPSQSSELLSEAKKLNDSQAPK

SEQ ID NO: 1160 - protein, 58 aa, ARTIFICIAL SEQUENCE
  Engineered IL-17A binding polypeptide
VDAKYAKEADHAAVEIANLPNLTWDQWHAFISKLRDDPSQSSELLSEAKKLNDSQAPK

SEQ ID NO: 1161 - protein, 58 aa, ARTIFICIAL SEQUENCE
  Engineered IL-17A binding polypeptide
VDAKYAKEADKAAFEIAFLPNLTWDQWDAFIAKLRDDPSQSSELLSEAKKLNDSQAPK

SEQ ID NO: 1162 - protein, 58 aa, ARTIFICIAL SEQUENCE
  Engineered IL-17A binding polypeptide
VDAKYAKEADLAAFEIALLPNLTWEQWFAFITKLRDDPSQSSELLSEAKKLNDSQAPK

SEQ ID NO: 1163 - protein, 58 aa, ARTIFICIAL SEQUENCE
  Engineered IL-17A binding polypeptide
VDAKYAKEADSAAMEIAVLPNLTWDQWFAFIMKLRDDPSQSSELLSEAKKLNDSQAPK

SEQ ID NO: 1164 - protein, 58 aa, ARTIFICIAL SEQUENCE
  Engineered IL-17A binding polypeptide
VDAKYAKEADAAAAEIADLPNLTWIQWDAFIHKLRDDPSQSSELLSEAKKLNDSQAPK

SEQ ID NO: 1165 - protein, 58 aa, ARTIFICIAL SEQUENCE
  Engineered IL-17A binding polypeptide
VDAKYAKEADFAAYEIADLPNLTWYQWHAFIQKLRDDPSQSSELLSEAKKLNDSQAPK

SEQ ID NO: 1166 - protein, 58 aa, ARTIFICIAL SEQUENCE
  Engineered IL-17A binding polypeptide
VDAKYAKEADQAAYEIADLPNLTWDQWDAFILKLRDDPSQSSELLSEAKKLNDSQAPK

SEQ ID NO: 1167 - protein, 58 aa, ARTIFICIAL SEQUENCE
  Engineered IL-17A binding polypeptide
VDAKYAKEADFAAMEIADLPNLTWDQWWAFITKLRDDPSQSSELLSEAKKLNDSQAPK

SEQ ID NO: 1168 - protein, 58 aa, ARTIFICIAL SEQUENCE
  Engineered IL-17A binding polypeptide
VDAKYAKEADMAAFEIAFLPNLTWDQWYAFIQKLRDDPSQSSELLSEAKKLNDSQAPK

SEQ ID NO: 1169 - protein, 58 aa, ARTIFICIAL SEQUENCE
  Engineered IL-17A binding polypeptide
VDAKYAKEADKAAVEIADLPNLTWDQWQAFIQKLRDDPSQSSELLSEAKKLNDSQAPK

SEQ ID NO: 1170 - protein, 58 aa, ARTIFICIAL SEQUENCE
  Engineered IL-17A binding polypeptide
VDAKYAKEADDAAIEIADLPNLTWDQWEAFILKLRDDPSQSSELLSEAKKLNDSQAPK

SEQ ID NO: 1171 - protein, 58 aa, ARTIFICIAL SEQUENCE
  Engineered IL-17A binding polypeptide
VDAKYAKEADVAAVEIAELPNLTWDQWWAFIDKLRDDPSQSSELLSEAKKLNDSQAPK

SEQ ID NO: 1172 - protein, 58 aa, ARTIFICIAL SEQUENCE
  Engineered IL-17A binding polypeptide
VDAKYAKEADQAAMEIAALPNLTWDQWDAFIGKLRDDPSQSSELLSEAKKLNDSQAPK

SEQ ID NO: 1173 - protein, 58 aa, ARTIFICIAL SEQUENCE
  Engineered IL-17A binding polypeptide
VDAKYAKEADAAAVEIAYLPNLTWDQWFAFIMKLRDDPSQSSELLSEAKKLNDSQAPK

SEQ ID NO: 1174 - protein, 58 aa, ARTIFICIAL SEQUENCE
  Engineered IL-17A binding polypeptide
VDAKYAKEADNAAMEIAELPNLTWIQWYAFINKLRDDPSQSSELLSEAKKLNDSQAPK

SEQ ID NO: 1175 - protein, 58 aa, ARTIFICIAL SEQUENCE
  Engineered IL-17A binding polypeptide
VDAKYAKEADQAAYEIASLPNLTWDQWLAFIDKLRDDPSQSSELLSEAKKLNDSQAPK

SEQ ID NO: 1176 - protein, 58 aa, ARTIFICIAL SEQUENCE
  Engineered IL-17A binding polypeptide
VDAKYAKEADGAAMEIAELPNLTWDQWEAFISKLRDDPSQSSELLSEAKKLNDSQAPK

SEQ ID NO: 1177 - protein, 58 aa, ARTIFICIAL SEQUENCE
  Engineered IL-17A binding polypeptide
VDAKYAKEADIAAVEIAGLPNLTWDQWFAFIGKLRDDPSQSSELLSEAKKLNDSQAPK

SEQ ID NO: 1178 - protein, 58 aa, ARTIFICIAL SEQUENCE
  Engineered IL-17A binding polypeptide
VDAKYAKEADTAALEIASLPNLTWDQWEAFIDKLRDDPSQSSELLSEAKKLNDSQAPK

SEQ ID NO: 1179 - protein, 58 aa, ARTIFICIAL SEQUENCE
  Engineered IL-17A binding polypeptide
VDAKYAKEADAAAFEIAALPNLTWFQWFAFIHKLRDDPSQSSELLSEAKKLNDSQAPK

SEQ ID NO: 1180 - protein, 58 aa, ARTIFICIAL SEQUENCE
  Engineered IL-17A binding polypeptide
VDAKYAKEADHAAMEIAMLPNLTWDQWFAFIAKLRDDPSQSSELLSEAKKLNDSQAPK

SEQ ID NO: 1181 - protein, 58 aa, ARTIFICIAL SEQUENCE
  Engineered IL-17A binding polypeptide
VDAKYAKEADRAAFEIAELPNLTWDQWEAFIGKLRDDPSQSSELLSEAKKLNDSQAPK

SEQ ID NO: 1182 - protein, 58 aa, ARTIFICIAL SEQUENCE
  Engineered IL-17A binding polypeptide
VDAKYAKEADSAAMEIADLPNLTWDQWLAFIDKLRDDPSQSSELLSEAKKLNDSQAPK

SEQ ID NO: 1183 - protein, 58 aa, ARTIFICIAL SEQUENCE
  Engineered IL-17A binding polypeptide
VDAKYAKEADTAAVEIAALPNLTWDQWQAFILKLRDDPSQSSELLSEAKKLNDSQAPK

SEQ ID NO: 1184 - protein, 58 aa, ARTIFICIAL SEQUENCE
  Engineered IL-17A binding polypeptide
VDAKYAKEADNAAYEIALLPNLTWDQWFAFIQKLRDDPSQSSELLSEAKKLNDSQAPK

SEQ ID NO: 1185 - protein, 58 aa, ARTIFICIAL SEQUENCE
  Engineered IL-17A binding polypeptide
VDAKYAKEADAAAFEIAELPNLTWLQWHAFINKLRDDPSQSSELLSEAKKLNDSQAPK

SEQ ID NO: 1186 - protein, 58 aa, ARTIFICIAL SEQUENCE
  Engineered IL-17A binding polypeptide
VDAKYAKEADSAALEIAGLPNLTWVQWWAFIGKLRDDPSQSSELLSEAKKLNDSQAPK

SEQ ID NO: 1187 - protein, 58 aa, ARTIFICIAL SEQUENCE
  Engineered IL-17A binding polypeptide
VDAKYAKEADWAAVEIANLPNLTWDQWDAFIDKLRDDPSQSSELLSEAKKLNDSQAPK

SEQ ID NO: 1188 - protein, 58 aa, ARTIFICIAL SEQUENCE
  Engineered IL-17A binding polypeptide
VDAKYAKEADKAALEIAQLPNLTWDQWWAFINKLRDDPSQSSELLSEAKKLNDSQAPK

SEQ ID NO: 1189 - protein, 58 aa, ARTIFICIAL SEQUENCE
  Engineered IL-17A binding polypeptide
VDAKYAKEADMAAVEIALLPNLTWDQWWAFISKLRDDPSQSSELLSEAKKLNDSQAPK

SEQ ID NO: 1190 - protein, 58 aa, ARTIFICIAL SEQUENCE
  Engineered IL-17A binding polypeptide
VDAKYAKEADVAAVEIALLPNLTWDQWEAFINKLRDDPSQSSELLSEAKKLNDSQAPK

SEQ ID NO: 1191 - protein, 58 aa, ARTIFICIAL SEQUENCE
  Engineered IL-17A binding polypeptide
VDAKYAKEADNAAFEIAFLPNLTWDQWWAFISKLRDDPSQSSELLSEAKKLNDSQAPK

SEQ ID NO: 1192 - protein, 58 aa, ARTIFICIAL SEQUENCE
  Engineered IL-17A binding polypeptide
VDAKYAKEADAAAMEIAVLPNLTWDQWWAFIDKLRDDPSQSSELLSEAKKLNDSQAPK

SEQ ID NO: 1193 - protein, 58 aa, ARTIFICIAL SEQUENCE
  Engineered IL-17A binding polypeptide
VDAKYAKEADIAAFEIAALPNLTWEQWWAFIWKLRDDPSQSSELLSEAKKLNDSQAPK

SEQ ID NO: 1194 - protein, 58 aa, ARTIFICIAL SEQUENCE
  Engineered IL-17A binding polypeptide
VDAKYAKEADRAAVEIALLPNLTWDQWHAFIQKLRDDPSQSSELLSEAKKLNDSQAPK

SEQ ID NO: 1195 - protein, 58 aa, ARTIFICIAL SEQUENCE
  Engineered IL-17A binding polypeptide
VDAKYAKEADAAAYEIAYLPNLTWIQWDAFIHKLRDDPSQSSELLSEAKKLNDSQAPK

SEQ ID NO: 1196 - protein, 58 aa, ARTIFICIAL SEQUENCE
  Engineered IL-17A binding polypeptide
VDAKYAKEADNAAIEIAELPNLTWDQWAAFIMKLRDDPSQSSELLSEAKKLNDSQAPK

SEQ ID NO: 1197 - protein, 58 aa, ARTIFICIAL SEQUENCE
  Engineered IL-17A binding polypeptide
VDAKYAKEADGAAMEIAGLPNLTWDQWFAFIMKLRDDPSQSSELLSEAKKLNDSQAPK

SEQ ID NO: 1198 - protein, 58 aa, ARTIFICIAL SEQUENCE
  Engineered IL-17A binding polypeptide
VDAKYAKEADWAAMEIALLPNLTWDQWEAFILKLRDDPSQSSELLSEAKKLNDSQAPK

SEQ ID NO: 1199 - protein, 58 aa, ARTIFICIAL SEQUENCE
  Engineered IL-17A binding polypeptide
VDAKYAKEADNAAMEIAALPNLTWEQWDAFIRKLRDDPSQSSELLSEAKKLNDSQAPK

SEQ ID NO: 1200 - protein, 58 aa, ARTIFICIAL SEQUENCE
  Engineered IL-17A binding polypeptide
VDAKYAKEHDYAWFEIWALPNLTWDQATAFIRKLNDDPSQSSELLSEAKKLNDSQAPK

SEQ ID NO: 1201 - protein, 58 aa, ARTIFICIAL SEQUENCE
  Engineered IL-17A binding polypeptide
VDAKYAKEMNRAQIEIWLLPNLTWHQQHAFIQKLIDDPSQSSELLSEAKKLNDSQAPK

SEQ ID NO: 1202 - protein, 58 aa, ARTIFICIAL SEQUENCE
  Engineered IL-17A binding polypeptide
VDAKYAKEADDAWWEIWALPNLTHAQGKAFIVKLLDDPSQSSELLSEAKKLNDSQAPK

SEQ ID NO: 1203 - protein, 58 aa, ARTIFICIAL SEQUENCE
  Engineered IL-17A binding polypeptide
VDAKYAKEAGDAQLEIWFLPNLTWAQSNAFIRKLIDDPSQSSELLSEAKKLNDSQAPK

SEQ ID NO: 1204 - protein, 58 aa, ARTIFICIAL SEQUENCE
  Engineered IL-17A binding polypeptide
VDAKYAKEGDQAAMEIAELPNLTWDQWFAFILKLRDDPSQSSELLSEAKKLNDSQAPK

SEQ ID NO: 1205 - protein, 58 aa, ARTIFICIAL SEQUENCE
  Engineered IL-17A binding polypeptide
VDAKYAKEADDAAVEIAALPNLTYDQWRAFIAKLRDDPSQSSELLSEAKKLNDSQAPK

SEQ ID NO: 1206 - protein, 58 aa, ARTIFICIAL SEQUENCE
  Engineered IL-17A binding polypeptide
VDAKYAKEADQAAMEIATLPNLTWDQWFAFIAKLRDDPSQSSELLSEAKKLNDSQAPK

SEQ ID NO: 1207 - protein, 58 aa, ARTIFICIAL SEQUENCE
  Engineered IL-17A binding polypeptide
VDAKYAKEADNAALEIADLPNLTWVQWNAFIQKLRDDPSQSSELLSEAKKLNDSQAPK

SEQ ID NO: 1208 - protein, 58 aa, ARTIFICIAL SEQUENCE
  Engineered IL-17A binding polypeptide
VDAKYAKEADDAAFEIAALPNLTARQWYAFISKLRDDPSQSSELLSEAKKLNDSQAPK

SEQ ID NO: 1209 - protein, 58 aa, ARTIFICIAL SEQUENCE
  Engineered IL-17A binding polypeptide
VDAKYAKETTYAWFEIWSLPNLTWDQQIAFIQKLNDDPSQSSELLSEAKKLNDSQAPK

SEQ ID NO: 1210 - protein, 58 aa, ARTIFICIAL SEQUENCE
  Engineered IL-17A binding polypeptide
VDAKYAKEADYAWFEIWSLPNLTYTQQSAFIRKLNDDPSQSSELLSEAKKLNDSQAPK

SEQ ID NO: 1211 - protein, 58 aa, ARTIFICIAL SEQUENCE
  Engineered IL-17A binding polypeptide
VDAKYAKEYDFAWFEIWLLPNLTRDQQSAFIHKLNDDPSQSSELLSEAKKLNDSQAPK

SEQ ID NO: 1212 - protein, 58 aa, ARTIFICIAL SEQUENCE
  Engineered IL-17A binding polypeptide
VDAKYAKEADEAWFEIWLLPNLTRSQASAFITKLNDDPSQSSELLSEAKKLNDSQAPK

SEQ ID NO: 1213 - protein, 58 aa, ARTIFICIAL SEQUENCE
  Engineered IL-17A binding polypeptide
VDAKYAKEADFAWFEIWALPNLTHDQSVAFIRKLNDDPSQSSELLSEAKKLNDSQAPK

SEQ ID NO: 1214 - protein, 58 aa, ARTIFICIAL SEQUENCE
  Engineered IL-17A binding polypeptide
VDAKYAKEMDNAQWEIWLLPNLTWAQQHAFIGKLIDDPSQSSELLSEAKKLNDSQAPK

SEQ ID NO: 1215 - protein, 58 aa, ARTIFICIAL SEQUENCE
  Engineered IL-17A binding polypeptide
VDAKYAKEMDDAWWEIWDLPNLTYYQQRAFIVKLVDDPSQSSELLSEAKKLNDSQAPK

SEQ ID NO: 1216 - protein, 58 aa, ARTIFICIAL SEQUENCE
  Engineered IL-17A binding polypeptide
VDAKYAKEWGEAQLEIWLLPNLTWWQGHAFIQKLLDDPSQSSELLSEAKKLNDSQAPK

SEQ ID NO: 1217 - protein, 60 aa, ARTIFICIAL SEQUENCE
  Engineered IL-17A binding polypeptide
AEAKYAKEADQAAMEIATLPNLTWDQWFAFIAKLRDDPSQSSELLSEAKKLNDSQAPKVD

SEQ ID NO: 1218 - protein, 58 aa, ARTIFICIAL SEQUENCE
  Engineered IL-17A binding polypeptide
AEAKYAKEADDAAVEIADLPNLTWDQWYAFISKLRDDPSQSSELLSEAKKLNDSQAPK

SEQ ID NO: 1219 - protein, 58 aa, ARTIFICIAL SEQUENCE
  Engineered IL-17A binding polypeptide
AEAKYAKEADDAAVEIASLPNLTWDQWYAFIQKLRDDPSQSSELLSEAKKLNDSQAPK

SEQ ID NO: 1220 - protein, 58 aa, ARTIFICIAL SEQUENCE
  Engineered IL-17A binding polypeptide
AEAKYAKEADDAAVEIAALPNLTWDQWFAFISKLRDDPSQSSELLSEAKKLNDSQAPK

SEQ ID NO: 1221 - protein, 58 aa, ARTIFICIAL SEQUENCE
  Engineered IL-17A binding polypeptide
AEAKYAKEADQAAVEIADLPNLTWAQWYAFIQKLRDDPSQSSELLSEAKKLNDSQAPK

SEQ ID NO: 1222 - protein, 58 aa, ARTIFICIAL SEQUENCE
  Engineered IL-17A binding polypeptide
AEAKYAKEADDAAVEIASLPNLTWAQWYAFIQKLRDDPSQSSELLSEAKKLNDSQAPK

SEQ ID NO: 1223 - protein, 58 aa, ARTIFICIAL SEQUENCE
  Engineered Taq polymerase binding polypeptide
VDAKYAKELGWATWEIFNLPNLTGVQVKAFIDKLRDDPSQSSELLSEAKKLNDSQAPK

SEQ ID NO: 1224 - protein, 46 aa, ARTIFICIAL SEQUENCE
  Engineered albumin binding polypeptide
LAEAKEAANAELDSYGVSDFYKRLIDKAKTVEGVEALKDAILAALP

SEQ ID NO: 1225 - protein, 49 aa, ARTIFICIAL SEQUENCE
  Engineered albumin binding polypeptide
GSSLAEAKEAANAELDSYGVSDFYKRLIDKAKTVEGVEALKDAILAALP

SEQ ID NO: 1226 - protein, 137 aa, HOMO SAPIENS
MIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 1227 - protein, 133 aa, MUS MUSCULUS
AAIIPQSSACPNTEAKDFLQNVKVNLKVFNSLGAKVSSRRPSDYLNRSTSPWTLHRNEDPDRYPSVIWEAQCRHQRCVNAEGKLDHHMNSVLIQQEILVLKREPESCPFTFRVEKMLVGVGCTCVASIVRQAA

SEQ ID NO: 1228 - protein, 134 aa, HOMO SAPIENS
MRKIPKVGHTFFQKPESCPPVPGGSMKLDIGIINENQRVSMSRNIESRSTSPWNYTVTWDPNRYPSEVVQAQCRNLGCINAQGKEDISMNSVPIQQETLVVRRKHQGCSVSFQLEKVLVTVGCTCVTPVIHHVQ

SEQ ID NO: 1229 - protein, 155 aa, MACACA FASCICULARIS
MTPGKTSLVLLLLLLSLEAIVKAGIAIPRNSGCPNSEDKNFPRTVMVNLNIHNRNTSTNPKRSSDYYNRSTSPWNLHRNEDPERYPSVIWEAKCRHLGCVKADGNVDYHMNSVPIQQEILVLRREPRHCPNSFRLEKILVSVGCTCVTPIVHHVA

SEQ ID NO: 1230 - protein, 132 aa, MACACA MULATTA
GIAIPRNPGCPNSEDKTFPRTVMVNLNIHNRNTNTNPKRSSDYYNRSTSPWNLHRNEDPERYPSVIWEAKCRHLGCVNADGNVDYHMNSVPIQQEILVLRREPRHCPNSFRLEKILVSVGCTCVTPIVHHVA

SEQ ID NO: 1231 - protein, 451 aa, ARTIFICIAL SEQUENCE
  Engineered heavy chain of adalimumab
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1232 - protein, 214 aa, ARTIFICIAL SEQUENCE
  Engineered light chain of adalimumab
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1233 - protein, 211 aa, ARTIFICIAL SEQUENCE
  Engineered IL-17A binding polypeptide
VDAKYAKEADQAAMEIATLPNLTWDQWFAFIAKLRDDPSQSSELLSEAKKLNDSQAPKGAPGGGGSGGGGSGGGGSGGGGSTSLAEAKEAANAELDSYGVSDFYKRLIDKAKTVEGVEALKDAILAALPGTGGGGSGGGGSGGGGSGGGGSPRVDAKYAKEADQAAMEIATLPNLTWDQWFAFIAKLRDDPSQSSELLSEAKKLNDSQAPK

SEQ ID NO: 1234 - protein, 201 aa, ARTIFICIAL SEQUENCE
  Engineered IL-17A binding polypeptide
VDAKYAKEADQAAMEIATLPNLTWDQWFAFIAKLRDDPSQSSELLSEAKKLNDSQAPKGAPGGGGSGGGGSGGGGSTSLAEAKEAANAELDSYGVSDFYKRLIDKAKTVEGVEALKDAILAALPGTGGGGSGGGGSGGGGSPRVDAKYAKEADQAAMEIATLPNLTWDQWFAFIAKLRDDPSQSSELLSEAKKLNDSQAPK

SEQ ID NO: 1235 - protein, 191 aa, ARTIFICIAL SEQUENCE
  Engineered IL-17A binding polypeptide
VDAKYAKEADQAAMEIATLPNLTWDQWFAFIAKLRDDPSQSSELLSEAKKLNDSQAPKGAPGGGGSGGGGSTSLAEAKEAANAELDSYGVSDFYKRLIDKAKTVEGVEALKDAILAALPGTGGGGSGGGGSPRVDAKYAKEADQAAMEIATLPNLTWDQWFAFIAKLRDDPSQSSELLSEAKKLNDSQAPK

SEQ ID NO: 1236 - protein, 211 aa, ARTIFICIAL SEQUENCE
  Engineered IL-17A binding polypeptide
VDAKYAKEADDAAVEIADLPNLTWDQWYAFISKLRDDPSQSSELLSEAKKLNDSQAPKGAPGGGGSGGGGSGGGGSGGGGSTSLAEAKEAANAELDSYGVSDFYKRLIDKAKTVEGVEALKDAILAALPGTGGGGSGGGGSGGGGSGGGGSPRVDAKYAKEADDAAVEIADLPNLTWDQWYAFISKLRDDPSQSSELLSEAKKLNDSQAPK

SEQ ID NO: 1237 - protein, 211 aa, ARTIFICIAL SEQUENCE
  Engineered IL-17A binding polypeptide
VDAKYAKEADDAAVEIASLPNLTWDQWYAFIQKLRDDPSQSSELLSEAKKLNDSQAPKGAPGGGGSGGGGSGGGGSGGGGSTSLAEAKEAANAELDSYGVSDFYKRLIDKAKTVEGVEALKDAILAALPGTGGGGSGGGGSGGGGSGGGGSPRVDAKYAKEADDAAVEIASLPNLTWDQWYAFIQKLRDDPSQSSELLSEAKKLNDSQAPK

SEQ ID NO: 1238 - protein, 175 aa, ARTIFICIAL SEQUENCE
  Engineered IL-17A binding polypeptide
VDAKYAKEADQAAMEIATLPNLTWDQWFAFIAKLRDDPSQSSELLSEAKKLNDSQAPKVDGSLAEAKEAANAELDSYGVSDFYKRLIDKAKTVEGVEALKDAILAALPGTGGGGSPRVDAKYAKEADQAAMEIATLPNLTWDQWFAFIAKLRDDPSQSSELLSEAKKLNDSQAPK

SEQ ID NO: 1239 - protein, 180 aa, ARTIFICIAL SEQUENCE
  Engineered IL-17A binding polypeptide
VDAKYAKEADQAAMEIATLPNLTWDQWFAFIAKLRDDPSQSSELLSEAKKLNDSQAPKVDGSLAEAKEAANAELDSYGVSDFYKRLIDKAKTVEGVEALKDAILAALPGTGGGGSGGGGSPRVDAKYAKEADQAAMEIATLPNLTWDQWFAFIAKLRDDPSQSSELLSEAKKLNDSQAPK

SEQ ID NO: 1240 - protein, 181 aa, ARTIFICIAL SEQUENCE
  Engineered IL-17A binding polypeptide
VDAKYAKEADQAAMEIATLPNLTWDQWFAFIAKLRDDPSQSSELLSEAKKLNDSQAPKGAPGGGGSTSLAEAKEAANAELDSYGVSDFYKRLIDKAKTVEGVEALKDAILAALPGTGGGGSPRVDAKYAKEADQAAMEIATLPNLTWDQWFAFIAKLRDDPSQSSELLSEAKKLNDSQAPK

SEQ ID NO: 1241 - protein, 186 aa, ARTIFICIAL SEQUENCE
  Engineered IL-17A binding polypeptide
VDAKYAKEADQAAMEIATLPNLTWDQWFAFIAKLRDDPSQSSELLSEAKKLNDSQAPKGAPGGGGSTSLAEAKEAANAELDSYGVSDFYKRLIDKAKTVEGVEALKDAILAALPGTGGGGSGGGGSPRVDAKYAKEADQAAMEIATLPNLTWDQWFAFIAKLRDDPSQSSELLSEAKKLNDSQAPK

SEQ ID NO: 1242 - protein, 175 aa, ARTIFICIAL SEQUENCE
  Engineered IL-17A binding polypeptide
AEAKYAKEADDAAVEIADLPNLTWDQWYAFISKLRDDPSQSSELLSEAKKLNDSQAPKVDGSLAEAKEAANAELDSYGVSDFYKRLIDKAKTVEGVEALKDAILAALPGTGGGGSPKAEAKYAKEADDAAVEIADLPNLTWDQWYAFISKLRDDPSQSSELLSEAKKLNDSQAPK

SEQ ID NO: 1243 - protein, 173 aa, ARTIFICIAL SEQUENCE
  Engineered IL-17A binding polypeptide
AEAKYAKEADDAAVEIADLPNLTWDQWYAFISKLRDDPSQSSELLSEAKKLNDSQAPKASGSLAEAKEAANAELDSYGVSDFYKRLIDKAKTVEGVEALKDAILAALPGTGGGGSAEAKYAKEADDAAVEIADLPNLTWDQWYAFISKLRDDPSQSSELLSEAKKLNDSQAPK

SEQ ID NO: 1244 - protein, 173 aa, ARTIFICIAL SEQUENCE
  Engineered IL-17A binding polypeptide
AEAKYAKEADDAAVEIASLPNLTWDQWYAFIQKLRDDPSQSSELLSEAKKLNDSQAPKASGSLAEAKEAANAELDSYGVSDFYKRLIDKAKTVEGVEALKDAILAALPGTGGGGSAEAKYAKEADDAAVEIASLPNLTWDQWYAFIQKLRDDPSQSSELLSEAKKLNDSQAPK

SEQ ID NO: 1245 - protein, 173 aa, ARTIFICIAL SEQUENCE
  Engineered IL-17A binding polypeptide
AEAKYAKEADDAAVEIAALPNLTWDQWFAFISKLRDDPSQSSELLSEAKKLNDSQAPKASGSLAEAKEAANAELDSYGVSDFYKRLIDKAKTVEGVEALKDAILAALPGTGGGGSAEAKYAKEADDAAVEIAALPNLTWDQWFAFISKLRDDPSQSSELLSEAKKLNDSQAPK

SEQ ID NO: 1246 - protein, 173 aa, ARTIFICIAL SEQUENCE
  Engineered IL-17A binding polypeptide
AEAKYAKEADQAAVEIADLPNLTWAQWYAFIQKLRDDPSQSSELLSEAKKLNDSQAPKASGSLAEAKEAANAELDSYGVSDFYKRLIDKAKTVEGVEALKDAILAALPGTGGGGSAEAKYAKEADQAAVEIADLPNLTWAQWYAFIQKLRDDPSQSSELLSEAKKLNDSQAPK

SEQ ID NO: 1247 - protein, 173 aa, ARTIFICIAL SEQUENCE
  Engineered IL-17A binding polypeptide
AEAKYAKEADDAAVEIASLPNLTWAQWYAFIQKLRDDPSQSSELLSEAKKLNDSQAPKASGSLAEAKEAANAELDSYGVSDFYKRLIDKAKTVEGVEALKDAILAALPGTGGGGSAEAKYAKEADDAAVEIASLPNLTWAQWYAFIQKLRDDPSQSSELLSEAKKLNDSQAPK

SEQ ID NO: 1248 - DNA, 147 bp, ARTIFICIAL SEQUENCE
  Library oligonucleotide
  misc_feature (39)..(47): n is a, c, g, or t
  misc_feature (51)..(56): n is a, c, g, or t
  misc_feature (63)..(68): n is a, c, g, or t
  misc_feature (84)..(89): n is a, c, g, or t
  misc_feature (93)..(98): n is a, c, g, or t
  misc_feature (108)..(110): n is a, c, g, or t
  misc_feature (117)..(119): n is a, c, g, or t
aaataaatctcgaggtagatgccaaatacgccaaagaannnnnnnnngcgnnnnnngagatcnnnnnnttacctaacttaaccnnnnnncaannnnnngccttcatcnnnaaattannngatgacccaagccagagctcattattta

SEQ ID NO: 1249 - DNA, 147 bp, ARTIFICIAL SEQUENCE
  Library oligonucleotide
  misc_feature (39)..(47): n is a, c, g, or t
  misc_feature (51)..(56): n is a, c, g, or t
  misc_feature (63)..(68): n is a, c, g, or t
  misc_feature (84)..(89): n is a, c, g, or t
  misc_feature (93)..(98): n is a, c, g, or t
  misc_feature (108)..(110): n is a, c, g, or t
  misc_feature (117)..(119): n is a, c, g, or t
aaataaatctcgaggtagatgcmaaatacgccaaagarnnnnnnnnngcgnnnnnngagatynnnnnnytrccyaacytmaccnnnnnncarnnnnnngccttcatcnnnaaattannngatgacccaagccagagctcattattta

SEQ ID NO: 1250 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
ADNNFNKEXDXAXXEIXXLPNLXXXQXXAFIXXLXXDPSQSANLLSEAKKLNESQAPK

SEQ ID NO: 1251 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
ADNKFNKEXDXAXXEIXXLPNLXXXQXXAFIXXLXXDPSQSANLLAEAKKLNDAQAPK

SEQ ID NO: 1252 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
ADNKFNKEXDXAXXEIXXLPNLXXXQXXAFIXXLXXDPSVSKEILAEAKKLNDAQAPK

SEQ ID NO: 1253 - protein, 61 aa, ARTIFICIAL SEQUENCE
  Engineered IL-17A binding polypeptide
  misc_feature (12)..(12): Xaa can be any naturally occurring amino acid
  misc_feature (14)..(14): Xaa can be any naturally occurring amino acid
  misc_feature (16)..(17): Xaa can be any naturally occurring amino acid
  misc_feature (20)..(21): Xaa can be any naturally occurring amino acid
  misc_feature (26)..(28): Xaa can be any naturally occurring amino acid
  misc_feature (30)..(31): Xaa can be any naturally occurring amino acid
  misc_feature (35)..(36): Xaa can be any naturally occurring amino acid
  misc_feature (38)..(39): Xaa can be any naturally occurring amino acid
ADAQQNNFNKEXDXAXXEIXXLPNLXXXQXXAFIXXLXXDPSQSTNVLGEAKKLNESQAPK

SEQ ID NO: 1254 - protein, 56 aa, ARTIFICIAL SEQUENCE
  Engineered IL-17A binding polypeptide
  misc_feature (7)..(7): Xaa can be any naturally occurring amino acid
  misc_feature (9)..(9): Xaa can be any naturally occurring amino acid
  misc_feature (11)..(12): Xaa can be any naturally occurring amino acid
  misc_feature (15)..(16): Xaa can be any naturally occurring amino acid
  misc_feature (21)..(23): Xaa can be any naturally occurring amino acid
  misc_feature (25)..(26): Xaa can be any naturally occurring amino acid
  misc_feature (30)..(31): Xaa can be any naturally occurring amino acid
  misc_feature (33)..(34): Xaa can be any naturally occurring amino acid
AQHDEEXDXAXXEIXXLPNLXXXQXXAFIXXLXXDPSQSANVLGEAQKLNDSQAPK

SEQ ID NO: 1255 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDNKFNKEXDXAXXEIXXLPNLXXXQXXAFIXXLXXDPSQSANLLAEAKKLNDAQAPK

SEQ ID NO: 1256 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSESSELLSEAKKLNKSQAPK

SEQ ID NO: 1257 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXDPSQSSELLAEAKKLNDAQAPK

SEQ ID NO: 1258 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXDPSQSSELLAEAKKLNDSQAPK

SEQ ID NO: 1259 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLSEAKKLNDSQAPK

SEQ ID NO: 1260 - protein, 57 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLSEAKKLNDSQAP

SEQ ID NO: 1261 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLSEAKKLNDAQAPK

SEQ ID NO: 1262 - protein, 57 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLSEAKKLNDAQAP

SEQ ID NO: 1263 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKFAKEXDXAXXEIXXLPNLXXXQXXAFIXXLXXDPSQSSELLSEAKKLNDSQAPK

SEQ ID NO: 1264 - protein, 57 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKFAKEXDXAXXEIXXLPNLXXXQXXAFIXXLXXDPSQSSELLSEAKKLNDSQAP

SEQ ID NO: 1265 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLAEAKKLNDAQAPK

SEQ ID NO: 1266 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLSEAKKLSESQAPK

SEQ ID NO: 1267 - protein, 57 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLSEAKKLSESQAP

SEQ ID NO: 1268 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKFAKEXDXAXXEIXXLPNLXXXQXXAFIXXLXXDPSQSSELLSEAKKLSESQAPK

SEQ ID NO: 1269 - protein, 57 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKFAKEXDXAXXEIXXLPNLXXXQXXAFIXXLXXDPSQSSELLSEAKKLSESQAP

SEQ ID NO: 1270 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLAEAKKLSEAQAPK

SEQ ID NO: 1271 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXQPEQSSELLSEAKKLSESQAPK

SEQ ID NO: 1272 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLSEAKKLESSQAPK

SEQ ID NO: 1273 - protein, 57 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLSEAKKLESSQAP

SEQ ID NO: 1274 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLAEAKKLESAQAPK

SEQ ID NO: 1275 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXQPEQSSELLSEAKKLESSQAPK

SEQ ID NO: 1276 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLSEAKKLSDSQAPK

SEQ ID NO: 1277 - protein, 57 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLSEAKKLSDSQAP

SEQ ID NO: 1278 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLAEAKKLSDSQAPK

SEQ ID NO: 1279 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLAEAKKLSDAQAPK

SEQ ID NO: 1280 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXQPEQSSELLSEAKKLSDSQAPK

SEQ ID NO: 1281 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXDPSQSSELLSEAKKLNDSQAPK

SEQ ID NO: 1282 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXDPSQSSELLSEAKKLSESQAPK

SEQ ID NO: 1283 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXDPSQSSELLAEAKKLSEAQAPK

SEQ ID NO: 1284 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXQPEQSSELLSEAKKLSESQAPK

SEQ ID NO: 1285 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXDPSQSSELLSEAKKLESSQAPK

SEQ ID NO: 1286 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXDPSQSSELLAEAKKLESAQAPK

SEQ ID NO: 1287 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXQPEQSSELLSEAKKLESSQAPK

SEQ ID NO: 1288 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXDPSQSSELLSEAKKLSDSQAPK

SEQ ID NO: 1289 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXDPSQSSELLAEAKKLSDSQAPK

SEQ ID NO: 1290 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXDPSQSSELLAEAKKLSDAQAPK

SEQ ID NO: 1291 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXQPEQSSELLSEAKKLSDSQAPK

SEQ ID NO: 1292 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
VDAKYAKEXDXAXXEIXXLPNLXXXQXXAFIXXLXXDPSQSSELLAEAKKLNKAQAPK

SEQ ID NO: 1293 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
AEAKYAKEXDXAXXEIXXLPNLXXXQXXAFIXXLXXDPSQSSELLAEAKKLNKAQAPK

SEQ ID NO: 1294 - protein, 58 aa, ARTIFICIAL SEQUENCE
  Engineered IL-17A binding polypeptide
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (23)..(25): Xaa can be any naturally occurring amino acid
  misc_feature (27)..(28): Xaa can be any naturally occurring amino acid
  misc_feature (32)..(33): Xaa can be any naturally occurring amino acid
  misc_feature (35)..(36): Xaa can be any naturally occurring amino acid
ADAKYAKEXDXAXXEIXXLPNLXXXQXXAFIXXLXXDPSQSSELLSEAKKLNDSQAPK

SEQ ID NO: 1295 - protein, 29 aa, artificial sequence
  Engineered IL-17A binding motif
  misc_feature (2)..(2): Xaa is selected from A, H, M and Y
  misc_feature (4)..(4): Xaa is A, D, E, F, K, L, M, N, Q, R, S or Y
  misc_feature (6)..(6): Xaa is selected from A, Q and W
  misc_feature (7)..(7): Xaa is selected from F, I, L, M, V, W and Y
  misc_feature (10)..(10): Xaa is selected from A and W
  misc_feature (11)..(11): Xaa is A, D, E, F, G, L, M, N, Q, S, T or Y
  misc_feature (16)..(16): Xaa is selected from N and T
  misc_feature (17)..(17): Xaa is selected from H, W and Y
  misc_feature (18)..(18): Xaa is selected from A, D, E, H and V
  misc_feature (20)..(20): Xaa is selected from A, G, Q, S and W
  misc_feature (21)..(21): Xaa is A, D, E, F, H, K, N, R, T, V, W or Y
  misc_feature (25)..(25): Xaa is A, D, E, G, H, I, L, M, N, Q, R, S, T or V
  misc_feature (26)..(26): Xaa is selected from K and S
  misc_feature (28)..(28): Xaa is selected from I, L, N and R
  misc_feature (29)..(29): Xaa is selected from D and R
EXDXAXXEIXXLPNLXXXQXXAFIXXLXX

SEQ ID NO: 1296 - protein, 49 aa, ARTIFICIAL SEQUENCE
  Engineered IL-17A binding module (BMod)
  misc_feature (3)..(3): Xaa is selected from A, H, M and Y
  misc_feature (5)..(5): Xaa is A, D, E, F, K, L, M, N, Q, R, S or Y
  misc_feature (7)..(7): Xaa is selected from A, Q and W
  misc_feature (8)..(8): Xaa is selected from F, I, L, M, V, W and Y
  misc_feature (11)..(11): Xaa is selected from A and W
  misc_feature (12)..(12): Xaa is A, D, E, F, G, L, M, N, Q, S, T or Y
  misc_feature (17)..(17): Xaa is selected from N and T
  misc_feature (18)..(18): Xaa is selected from H, W and Y
  misc_feature (19)..(19): Xaa is selected from A, D, E, H and V
  misc_feature (21)..(21): Xaa is selected from A, G, Q, S and W
  misc_feature (22)..(22): Xaa is A, D, E, F, H, K, N, R, T, V, W or Y
  misc_feature (26)..(26): Xaa is A, D, E, G, H, I, L, M, N, Q, R, S, T or V
  misc_feature (27)..(27): Xaa is selected from K and S
  misc_feature (29)..(29): Xaa is selected from I, L, N and R
  misc_feature (36)..(36): Xaa can be A or S
  misc_feature (37)..(37): Xaa can be N or E
  misc_feature (40)..(40): Xaa can be A, S, or C
  misc_feature (46)..(46): Xaa can be E, N, or S
  misc_feature (47)..(47): Xaa can be D, E, or S
  misc_feature (48)..(48): Xaa can be A or S
KEXDXAXXEIXXLPNLXXXQXXAFIXXLXDDPSQSXXLLXEAKKLXXXQ

SEQ ID NO: 1297 - protein, 49 aa, Artificial sequence
  Engineered IL-17A binding Module (BMod)
  misc_feature (3)..(3): Xaa is selected from A, H, M and Y
  misc_feature (5)..(5): Xaa is A, D, E, F, K, L, M, N, Q, R, S or Y
  misc_feature (7)..(7): Xaa is selected from A, Q and W
  misc_feature 8)..(8): Xaa is selected from F, I, L, M, V, W and Y
  misc_feature (11)..(11): Xaa is selected from A and W
  misc_feature (12)..(12): Xaa is A, D, E, F, G, L, M, N, Q, S, T or Y
  misc_feature (17)..(17): Xaa is selected from N and T
  misc_feature (18)..(18): Xaa is selected from H, W and Y
  misc_feature (19)..(19): Xaa is selected from A, D, E, H and V
  misc_feature (21)..(21): Xaa is selected from A, G, Q, S and W
  misc_feature (22)..(22): Xaa is A, D, E, F, H, K, N, R, T, V, W or Y
  misc_feature (26)..(26): Xaa is A, D, E, G, H, I, L, M, N, Q, R, S, T or V
  misc_feature (27)..(27): Xaa can be K or S
  misc_feature (29)..(29): Xaa is selected from I, L, N and R
  misc_feature (36)..(36): Xaa can be A or S
  misc_feature (37)..(37): Xaa can be N or E
  misc_feature (40)..(40): Xaa can be A, S or C
  misc_feature (46)..(46): Xaa is E, N, or S
  misc_feature (47)..(47): Xaa is D, E, or S
  misc_feature (48)..(48): Xaa is A or S
KEXDXAXXEIXXLPNLXXXQXXAFIXXLXRQPEQSXXLLXEAKKLXXXQ

SEQ ID NO: 1298 - protein, 5 aa, ARTIFICIAL SEQUENCE
  Engineered IL-17A-binding polypeptide
  misc_feature (3)..(3): Xaa is an IL-17A binding module (BMod)
YAXAP

SEQ ID NO: 1299 - protein, 5 aa, artificial sequence
  engineered IL-17A binding polypeptide
  misc_feature (3)..(3): Xaa is an IL-17A binding module (BMod)
FAXAP

SEQ ID NO: 1300 - protein, 5 aa, ARTIFICIAL SEQUENCE
  ENGINEERED IL-17A BINDING POLYPEPTIDE
  misc_feature (3)..(3): Xaa is an IL-17A binding module (BMod)
FNXAP

SEQ ID NO: 1301 - protein, 5 aa, ARTIFICIAL SEQUENCE
  LINKER
GGGGS

SEQ ID NO: 1302 - protein, 5 aa, ARTIFICIAL SEQUENCE
  LINKER
SSSSG

SEQ ID NO: 1303 - protein, 10 aa, Artificial sequence
  Linker
GGGGSGGGGS

SEQ ID NO: 1304 - protein, 15 aa, Artificial sequence
  Linker
GGGGSGGGGSGGGGS

SEQ ID NO: 1305 - protein, 20 aa, Artificial sequence
  Linker
GGGGSGGGGSGGGGSGGGGS

SEQ ID NO: 1306 - protein, 7 aa, Artificial sequence
  Linker
GTGGGGS

SEQ ID NO: 1307 - protein, 8 aa, ARtificial sequence
  Linker
GAPGGGGS

SEQ ID NO: 1308 - protein, 15 aa, artificial sequence
  linker
SSSSGSSSSGSSSSG

SEQ ID NO: 1309 - protein, 20 aa, Artificial Sequence
  Linker
SSSSGSSSSGSSSSGSSSSG

SEQ ID NO: 1310 - protein, 40 aa, artificial sequence
  linker
SSSSGSSSSGSSSSGSSSSGSSSSGSSSSGSSSSGSSSSG

SEQ ID NO: 1311 - protein, 4 aa, ARtificial sequence
  linker
VDGS

SEQ ID NO: 1312 - protein, 4 aa, artificial sequence
  linker
ASGS

SEQ ID NO: 1313 - protein, 4 aa, artificial sequence
  linker
VEGS

SEQ ID NO: 1314 - protein, 18 aa, artificial sequence
  Fusion of IL-17A binding peptide and ABD
  misc_feature (9)..(9): Xaa is an IL-17A binding Z-variant
  misc_feature (14)..(14): Xaa is an albumin binding domain
AQHDEALEXVDYVXYVPG

SEQ ID NO: 1315 - protein, 15 aa, artificial sequence
  His-tagged IL-17RA binding polypeptide
  misc_feature (13)..(13): Xaa is an IL-17A binding Z-variant
MGSSHHHHHHLQXVD

SEQ ID NO: 1316 - protein, 12 aa, artificial sequence
  synthetic construct of Z variant+PP013
  misc_feature (7)..(7): Xaa is an IL-17A binding Z-variant
  misc_feature (12)..(12): Xaa is PP013
MGSSLQXVDSSX

SEQ ID NO: 1317 - protein, 9 aa, artificial sequence
  linker
GTGGGGSPK

The invention claimed is:

1. An IL-17A binding polypeptide, comprising an IL-17A binding motif BM, which motif consists of an amino acid sequence selected from:
i) $EX_2DX_4AX_6X_7EIX_{10}X_{11}LPNL X_{16}X_{17}X_{18}QX_{20}X_{21}AFIX_{25} X_{26}LX_{28}X_{29}$ (SEQ ID NO:1295)
wherein, independently from each other,
$X_2$ is selected from A, H, M and Y;
$X_4$ is selected from A, D, E, F, K, L, M, N, Q, R, S and Y;
$X_6$ is selected from A, Q and W;
$X_7$ is selected from F, I, L, M, V, W and Y;
$X_{10}$ is selected from A and W;
$X_{11}$ is selected from A, D, E, F, G, L, M, N, Q, S, T and Y;
$X_{16}$ is selected from N and T;
$X_{17}$ is selected from H, W and Y;
$X_{18}$ is selected from A, D, E, H and V;
$X_{20}$ is selected from A, G, Q, S and W;
$X_{21}$ is selected from A, D, E, F, H, K, N, R, T, V, W and Y;

X₂₅ is selected from A, D, E, G, H, I, L, M, N, Q, R, S, T and V;
X₂₆ is selected from K and S;
X₂₈ is selected from I, L, N and R; and
X₂₉ is selected from D and R;
and
ii) an amino acid sequence which has at least 96% identity to the sequence defined in i).

2. The IL-17A binding polypeptide according to claim 1, wherein, in sequence i),
X₂ is selected from A, H and M;
X₄ is selected from A, D, E, F, L, M, N, Q, R and Y;
X₁₁ is selected from A, D, E, F, G, L, M, N, S, T and Y;
X₁₈ is selected from A, D, E and V;
X₂₀ is selected from A, G, Q and W;
X₂₁ is selected from E, F, H, N, R, T, V, W and Y;
X₂₅ is selected from A, D, E, G, H, I, L, N, Q, R, S, T and V; and
X₂₈ is selected from I, N and R.

3. The IL-17A binding polypeptide according to claim 2, wherein, in sequence i),
X₁₆ is T;
X₁₇ is W;
X₂₁ is selected from E, F, H, W, T and Y;
X₂₅ is selected from A, D, E, G, H, I, L, N, Q, R, S and T;
X₂₆ is K; and
X₂₉ is D.

4. The IL-17A binding polypeptide according to claim 1, wherein sequence i) consists of amino acids 8 to 36 of any one of SEQ ID NO:1-1216.

5. The IL-17A binding polypeptide according to claim 1, which comprises a binding module, BMod, consisting of the amino acid sequence K-[BM]-DPSQS X$_a$X$_b$LLX$_c$EAKKLX$_d$X$_e$X$_f$Q (SEQ ID NO: 1296)
wherein
[BM] is the IL-17A binding motif as defined in claim 1 provided that X₂₉ is D;
X$_a$ is selected from A and S;
X$_b$ is selected from N and E;
X$_c$ is selected from A, S and C;
X$_d$ is selected from E, N and S;
X$_e$ is selected from D, E and S; and
X$_f$ is selected from A and S.

6. The IL-17A binding polypeptide according to claim 5, wherein said BMod consists of amino acids 7 to 55 of any one of SEQ ID NO:1-1216.

7. The IL-17A binding polypeptide according to claim 5, which comprises the amino acid sequence:
YA-[BMod]-AP (SEQ ID NO:1298);
wherein [BMod] is the binding module as defined in claim 5.

8. The IL-17A binding polypeptide according to claim 1, which comprises the amino acid sequence:
VDAKYAK-[BM]-DPSQSSELLSEAKKLNDSQAPK (SEQ ID NO:1281);
wherein [BM] is the IL-17A binding motif as defined in claim 1.

9. The IL-17A binding polypeptide according to claim 5, which comprises an amino acid sequence selected from the group consisting of SEQ ID NO:1-1216.

10. The IL-17A binding polypeptide according to claim 1, which comprises the amino acid sequence:
AEAKYAK-[BM]-DPSQSSELLSEAKKLNDSQAPK (SEQ ID NO:1259);
wherein [BM] is the IL-17A binding motif as defined in claim 1.

11. The IL-17A binding polypeptide according to claim 10, which comprises an amino acid sequence selected from the group consisting of SEQ ID NO:1217-1222.

12. The IL-17A binding polypeptide according to claim 1, which binds to IL-17A with a $K_D$ value of at most $1 \times 10^{-6}$ M.

13. A fusion protein or conjugate comprising
a first moiety consisting of the IL-17A binding polypeptide according to claim 1; and
a second moiety consisting of a polypeptide having a desired biological activity.

14. A composition comprising the IL-17A binding polypeptide according to claim 1 or the fusion protein or conjugate according to claim 13, and at least one pharmaceutically acceptable excipient or carrier.

15. A medicament, diagnostic agent or prognostic agent comprising the IL-17A binding polypeptide according to claim 1 or the fusion protein or conjugate according to claim 13.

16. A complex, comprising at least one IL-17A binding polypeptide according to claim 1 or at least one fusion protein or conjugate according to claim 13, and at least one antibody or an antigen binding fragment thereof.

17. A composition comprising complex according to claim 16 and at least one pharmaceutically acceptable excipient or carrier.

18. A medicament, diagnostic agent or prognostic agent comprising the complex according to claim 16.

19. A polynucleotide encoding the IL-17A binding polypeptide according to claim 1.

* * * * *